US007598084B2

(12) United States Patent
Forster et al.

(10) Patent No.: US 7,598,084 B2
(45) Date of Patent: Oct. 6, 2009

(54) MODIFICATIONS OF PLANT TRAITS USING CYCLIN A

(75) Inventors: Richard L. Forster, Auckland (NZ); Marie B. Connett, Canberra (AU); Sarah Jane Emerson, Auckland (NZ); Murray Robert Grigor, Auckland (NZ); Colleen M. Higgins, Auckland (NZ); Steven Troy Lund, Vancouver (CA); Andreas Magusin, Norwich (GB); Bob Kodrzycki, Summerville, SC (US)

(73) Assignee: Arborgen LLC, Summerville, SC (US)

( * ) Notice: Subject to any disclaimer, the term of this patent is extended or adjusted under 35 U.S.C. 154(b) by 321 days.

(21) Appl. No.: 11/024,959

(22) Filed: Dec. 30, 2004

(65) Prior Publication Data

US 2006/0010516 A1    Jan. 12, 2006

Related U.S. Application Data

(60) Provisional application No. 60/533,036, filed on Dec. 30, 2003.

(51) Int. Cl.
*C12N 15/82* (2006.01)
*C12N 15/29* (2006.01)
*A01H 5/00* (2006.01)

(52) U.S. Cl. .................. 435/419; 800/298; 800/319; 435/320.1

(58) Field of Classification Search ....................... None
See application file for complete search history.

(56) References Cited

U.S. PATENT DOCUMENTS

| 5,593,867 A | 1/1997 | Walker et al. |
| 2002/0083495 A1 | 6/2002 | Connett-Porceddu et al. |
| 2002/0100083 A1 | 7/2002 | Connett-Porceddu et al. |
| 2002/0107644 A1 | 8/2002 | Meglen et al. |
| 2002/0113212 A1 | 8/2002 | Meglen et al. |

FOREIGN PATENT DOCUMENTS

| EP | 0 154 204 B1 | 1/1994 |
| EP | 0 271 988 B1 | 8/1995 |
| EP | 1 225 231 A1 | 7/2002 |
| WO | WO 95/11755 A1 | 5/1995 |
| WO | WO 99/32660 A1 | 7/1999 |
| WO | WO 00/52169 A | 9/2000 |
| WO | WO 00/56905 A2 | 9/2000 |
| WO | WO 00/65040 A2 | 11/2000 |
| WO | WO 01/75164 A3 | 10/2001 |
| WO | WO 2005/065339 A2 | 7/2005 |

OTHER PUBLICATIONS

Whisstock J.C. et al. Prediction of protein function from protein sequence and structure. Q Rev Biophys. Aug. 2003;36(3):307-40. Review.*

Renaudin J.P. et al. Plant cyclins: a unified nomenclature for plant A-, B- and D-type cyclins based on sequence organization. Plant Mol Biol. Dec. 1996;32(6):1003-18. Review.*
Hill M.A. et al. Functional analysis of conserved histidines in ADP-glucose pyrophosphorylase from *Escherichia coli*. Biochem Biophys Res Commun. Mar. 17, 1998;244(2):573-7.*
Rhoads D.M. et al. Regulation of the cyanide-resistant alternative oxidase of plant mitochondria. Identification of the cysteine residue involved in alpha-keto acid stimulation and intersubunit disulfide bond formation. J Biol Chem. Nov. 13, 1998;273(46):30750-6.*
Roundier F. et al. The Medicago species A2-type cyclin is auxin regulated and involved in meristem formation but dispensable for endoreduplication-associated developmental programs. Plant Physiol. Mar. 2003;131(3):1091-103.*
Renaudin J. P. et al. Plant cyclins: a unified nomenclature for plant A-, B- and D-type cyclins based on sequence organization. Plant Mol Biol. Dec. 1996;32(6):1003-18. Review.*
U.S. Appl. No. 60/476,189, filed Jun. 6, 2003, Grigor.
U.S. Appl. No. 60/476,222, filed Jun. 6, 2003, Chang.
Abrahams et al., "A novel and highly divergent *Arabidopsis* cyclin isolated by complementation in budding yeast," Biochimica et Biophysica Acta, vol. 1539, pp. 1-6, (2001).
Ach et al., "RRB1 and RRB2 Encode Maize Retinoblastoma-Related Proteins That Interact with a Plant D-Type Cyclin and Geminivirus Replication Protein," Molecular and Cellular Biology, vol. 17, No. 9, pp. 5077-5086, (Sep. 1997).
Ach et al., "A Conserved Family of WD-40 Proteins Binds to the Retinoblastoma Protein in Both Plants and Animals," Plant Cell, vol. 9, pp. 1595-1606, (Sep. 1997).
Aharoni et al., "Novel Insight into Vascular, Stress, and Auxin-Dependent and -Independent Gene Expression Programs in Strawberry, a Non-Climacteric Fruit," Plant Physiology, , vol. 129, pp. 1019-1031, (Jul. 2002).
Allona et al., "Analysis of xylem formation in pine by cDNA sequencing," Proc. Nat'l Acad. Science U.S.A.,, vol. 95, pp. 9693-9698, (Aug. 1998).
Altschul et al., "Basic Local Alignment Search tool," J. Mol. Biol., vol. 215, pp. 403-410, (1990).
An et al., "Organ-Specific and Developmental Regulation of the Nopaline Synthase Promotor in Transgenic Tobacco Plants," Plant Physiology., vol. 88, pp. 547-552, (1988).
Aronen, Tuija, Genetic transformation of Scots pine (*Pinus sylvestris* L.), Dissertation Metsäntutkimuslaitoksen tiedonantoja, The Finnish Forest Research Institute, Research papers 595, vol. 595, pp. 8-53, (1996).

(Continued)

*Primary Examiner*—Cynthia Collins
(74) *Attorney, Agent, or Firm*—Foley & Lardner LLP

(57) ABSTRACT

Novel plant polysaccharide synthesis genes and polypeptides encoded by such genes are provided. These genes and polynucleotide sequences are useful regulating polysaccharide synthesis and plant phenotype. Moreover, these genes are useful for expression profiling of plant polysaccharide synthesis genes. The invention specifically provides cell cycle polynucleotide and polypeptide sequences isolated from *Eucalyptus* and *Pinus*. The invention also provides for the expression of cyclin A genes to modify the physical traits of a transgenic plant.

4 Claims, 8 Drawing Sheets

OTHER PUBLICATIONS

Audic et al., "The Significance of Digital Gene Expression Profiles," Genome Research, 1997, vol. 7, pp. 986-995.

Austin et al., "Production and field performance of transgenic alfalfa (*Medicago sativa* L.) expressing alpha-amylase abnd manganese-dependent lignin peroxidase," Euphytica, vol. 85, pp. 381-393, (1995).

Balasubramanyam et al., "Small Molecule Modulators of histone Acetyltransferase p300," Journal of Biological Chemistry, vol. 278, No. 21, pp. 19134-19140, (May 2003).

Baumann et al., "The DNA Binding site of the Dof Protein NtBBF1 is Essential for Tissue-Specific and Auxin-Regulated Expression of the *rolB* Oncogene in Plants," The Plant Cell, vol. 11, pp. 323-333, (Mar. 1999).

Ben-Haj-Sahal et al., "Temperature Affects Expansion Rate of Maize Leaves without Change in Spatial Distribution of Cell Length," Plant Physiology, vol. 109, pp. 861-870, (1995).

Bhat et. al., "Alteration of GCN5 levels in maize reveals dynamic responses to manipulating histone acetylation," Plant Journal, vol. 33, pp. 455-469, (2003).

Breyne et al., "Genome-wide expression analysis of plant cell cycle modulated genes," Plant Biology, vol. 4, pp. 136-142, (2001).

Brutlag et al., "Improved Sensitivity of Biological Sequence Database Searches," Computer Applications in the Biosciences, vol. 6, No. 3, pp. 237-245, (Jun. 1990).

Cheong et al., "Transcriptional Profiling Reveals Novel Interactions between Wounding, Pathogen, Abiotic Stress, and Hormonal Responses in *Arabidopsis*," Plant Physiology, , vol. 129, pp. 661-677, (Jun. 2002).

Cockcroft et al., "Cyclin D control growth rate in plants," Nature, vol. 405, pp. 575-579, (Jun. 1, 2000).

Devereux et al., "A Comprehensive Set of Sequence Analysis Programs for the VAX," Nucleic Acids Research, vol. 12 No. 1, pp. 387-395, (1984).

Edvardsson et al., "The major peptidyl-prolyl isomerase activity in thylakoid lumen of plant chloroplasts belongs to a novel cyclophilin TLP20," FEBS letters, vol. 542, pp. 137-142, (2003).

Elbashir et al., "Functional anatomy of siRNAs for mediating efficient RNAi in *Drosophila melanogaster* embryo lysate," EMBO Journal, vol. 20, No. 23, pp. 6877-6888, (2001).

Elbashir et al., "Duplexes of 21-nucleotide RNAs mediate RNA interference in cultured mammalian cells," Nature, vol. 411, pp. 492-498, (May 2001).

Elbashir et al., "Analysis of gene function in somatic mammalian cells using small interfering RNAs," Methods, vol. 26, pp. 199-213, (2002).

Ellis et al., "Stable transformation of picea-glauca by particle-acceleration," Biotechnology, vol. 11, pp. 84-89, (Jan. 1993). (Abstract Only).

Fowler et al., "The Plant Cell Cycle in Context." Molecular Biotechnology, vol. 10, pp. 123-153, (Oct. 1998).

Fromm et al., "An Octopine Synthase Enhancer Element Directs Tissue-Specific Expression and Binds ASF-1, a Factor from Tobacco Nuclear Extracts," The Plant Cell,, vol. 1, pp. 977-984, (Oct. 1989).

Gastal et al., "Nitrogen Use within the Growing Leaf Blade of Tall Fescue," Plant Physiology, vol. 105, pp. 191-197, (1994).

Gleave et al., "A versatile binary vector system with a T-DNA organizational structure conducive to efficient integration of cloned DNA into the plant genome," Plant Molecular Biology, vol. 20, pp. 1203-1207, (1992).

Goh et al., "Cdc20 protein contains a destruction-box but, unlike Clb2, its proteolysis is not acutely dependent on the activity of anaphase-promoting complex," European. J. Biochemistry, vol. 267, pp. 434-449, (2000).

Grafi et al., "A maize cDNA encoding a member of the retinoblastoma protein family: Involvement in endoreduplication," Proc. National. Acad. Sci. U.S.A., Cell Biology, vol. 93, pp. 8962-8967, (Aug. 1996).

Guevara-Garcia et al., "A 42 bp Fragment of the *pmas*1' Promoter Containing an *ocs*-like Element Confers a Developmental, Wound- and Chemically Inducible Expression Pattern," Plant Molecular Biology, vol. 38, pp. 743-753, (1998).

Harborth et al., "Identification of essential genes in cultured mammalian cells using small interfering RNAs," Journal of Cell Science, vol. 114, pp. 4557-4565, (Oct. 2001).

Hertzberg et al., "cDNA Microarray Analysis of Small Plant Tissue Samples Using a cDNA Tag Target Amplification Protocol," The Plant Journal, vol. 25, No. 5, pp. 585-591, (2001).

Hertzberg et al., "A Transcriptional Roadmap to Wood Formation," PNAS, vol. 98, No. 25, pp. 14732-14737, (Dec. 4, 2001).

Hinchee et al., "Production of Transgenic Soybean Plants Using Agrobacterium-Mediated DNA Transfer," Bio/Technology, vol. 6, pp. 915-922, (Aug. 1988).

Huang et al., "Agrobacterium Rhizogenes-Mediated Genetic Transformation and Regeneration of a Conifer: *Larix decidua*," In Vitro Cell. Dev. Rept., vol. 27, pp. 201-207, (Oct. 1991).

Huber et al., "Detection of Single Base Alterations in Genomic DNA by Solid Phase Polymerase Chain Reaction on Oligonucleotide Microarrays," Analytical Biochemistry, vol. 299, pp. 24-30, (2001).

Hughes et al., "Expression Profiling Using Microarrays Fabricated by an Ink-Jet Oligonucleotide Synthesizer," Nature Biotechnology, vol. 19, pp. 342-347, (Apr. 2001).

Hutvågner et al., "A Cellular Function for the RNA-Interference Enzyme Dicer in the Maturation of the let-7 Small Temporal RNA," Science, vol. 293, pp. 834-838, (Aug. 2001).

John et al., "Cyclin/Cdk complexes: their involvement in cell cycle progression and mitotic division," Protoplasma, vol. 216, pp. 199-142, (2001).

Joubès et al., "A New C-Type Cyclin-Dependent Kinase from Tomato Expressed in Dividing Tissues Does Not Interact with Mitotic and G1 Cyclins," Plant Physiology, vol. 126, pp. 1403-1415, (Aug. 2001).

Joubès et al., "CDK-related protein kinases in plants," Plant Molecular biology, vol. 43, pp. 607-630, (2000).

Joubès et al., Molecular and Biochemical Characterization of the Involvement of Cyclin-Dependent Kinase A during the Early Development of Tomato Fruit, Plant Physiology, vol. 121, pp. 857-869, (Nov. 1999).

Kane et al., "Assessment of the Sensitivity and Specificity of Oligonucleotide (50mer) Microarrays," Nucleic Acids Research, vol. 28, No. 22, pp. 4552-4557, (2000).

Kirst et al., Analysis of Microarray Gene Expression Levels as Quantitative Traits: Discovery of Candidate Genes, Regulatory Networks and Mapping of Gene Expression Qtls., International Union of Forestry Research Organizations biennial conference, (Jun. 2003).

Lagos-Quintana et al., "Identification of Tissue-Specific MicroRNAs from Mouse," Current Biology, vol. 12, pp. 735-739, (Apr. 2002).

Lagos-Quintana et al., "Identification of Novel Genes Coding for Small Expressed RNAs, Science," Science, vol. 294, pp. 853-858, (Oct. 2001).

Lechner et al., A comparative study of histone deacetylases of plant, fungal and vertebrate cells, Biochimica et biophsica Acta, vol. 1296, pp. 181-188, (1996).

Li et al., "Selection of Optimal DNA Oligos for Gene Expression Arrays," Bioinformatics, vol. 17, No. 11, pp. 1067-1076, (2001).

Lockhart et al., "Expression Monitoring by Hybridization to High-Density Oligonucleotide Arrays," Nature Biotechnology, vol. 14, pp. 1675-1680, (Dec. 1996).

Lusser et al., "Analysis of the histone acetyltransferase B complex of maize embryos," Nucleic Acids Research, vol. 27, No. 22, pp. 4427-4435, (1999).

Mariconti et al., The E2F Family of Transcription Factors from *Arabidopsis thaliana*, The Journal of Biological Chemistry, vol. 277, No. 12, pp. 9911-9919, (2002).

Marita et al., "NMR Characterization of Lignins from Transgenic Poplars with Suppressed Caffeic Acid O-methyltransferase Activity," Journal of the Chemical Society, Perkin Trans. 1, pp. 2939-2945, (2001).

Martinez et al., "Single-Stranded Antisense siRNAs Guide Target RNA Cleavage in RNAi," Cell, vol. 110, pp. 563-574, (Sep. 2002).

McGall et al., "Light-Directed Synthesis of High-Density Oligonucleotide Arrays Using Semiconductor Photoresists," Proc. Natl. Acad. Sci. U.S.A., vol. 93, pp. 13555-13560, (Nov. 1996).

McManus et al., "Gene Silencing in Mammals by Small Interfering RNAs, Nature Rev. Genetics," Nature Reviews, vol. 3, pp. 737-747(Oct. 2002).

Meiyanto et al., "Application of Fluorescently Labeled Poly(dU) for Gene Expression Profiling on cDNA Microarrays," BioTechniques, vol. 31, No. 2, pp. 406-413, (Aug. 2001).

Mironov et al., "Cyclin-Dependent Kinases and Cell Division in Plants-The Nexus," Plant Cell, vol. 11, pp. 509-521, (Apr. 1999).

Nagata et al., "Tobacco BY-2 Cell Line as the 'HeLa' Cell in the Cell Biology of Higher Plants," International Review of Cytology, vol. 132, pp. 1-30, (1992).

Odell et al., "Identification of DNA Sequences Required for Activity of the Cauliflower Mosaic Virus 35S Promoter," Nature, vol. 313, No. 28, pp. 810-812, (Feb. 1985).

Pettersen et al., "Wood Sugar Analysis by Anion Chromatography," Journal of Wood Chemistry and Technology, vol. 11, No. 4, pp. 495-501, (1991).

Potrykus et al., "Direct Gene Transfer to Cells of a Graminaceous Monocot," Mol. Gen. Genet, vol. 199, pp. 183-188, (1985).

Prashar et al., "Reads: A Method for Display of 3'-End Fragments of Restriction Enzyme-Digested cDNAs for Analysis of Differential Gene Expression," Methods in Enzymology, vol. 303, pp. 258-272, (1999).

Relógio, et al., "Optimization of oligonucleotide-based DNA microarrays," Nucleic Acids Research, vol. 30, No. 11, pp. 1-10, (2002).

Renaudin et al., "Plant cyclins: a unified nomenclature for plant A-, B-, and D-type cyclins based on sequence organization," Plant Molecular Biology, vol. 32, pp. 1003-1018, (1996).

Riou-Khamlichi et al., "Sugar Control of the Plant Cell Cycle: Differential Regulation of Arabidopsis D-Type Cyclin Gene Expression," Molecular and Cellular Biology, vol. 20, No. 13, pp. 4513-4521, (Jul. 2000).

Rossi et al., "A maize histone deacetylase and retinoblastoma-related protein physically interact and cooperate in repressing gene transcription," Plant Molecular Biology, 2003, vol. 51, pp. 401-413.

Rydelius et al., "Growing Eucalyptus for Pulp and Energy," presented at the Mechanization in Short Rotation, Intensive Culture Forestry Conference, Mobile, AL, pp. 53-56, (1994).

Sacks et al., "Effect of Water Stress on Cortical Cell Division Rates within the Apical Meristem of Primary Roots of Maize," Plant Physiol., vol. 114, pp. 519-527, (1997).

Schenk, et al., "Coordinated plant defense responses in Arabidopsis revealed by microarray analysis," PNAS, vol. 97, No. 21, pp. 11655-11660, (2000).

Schultz et al., "Targeting histone deacetylase complexes via KRAB-zinc finger proteins: the PHD and bromodomains of KAP-1 form a cooperative unit that recruits a novel isoform of the mi-2α subunit of NuRD," Genes & Development, 2001, vol. 15, pp. 428-443.

Sheldon et al., "Purification and characterization of cytosolic and microsomal cyclophilins from maize, (Zea mays)" Biochemistry Journal, vol. 315, pp. 965-969, (1996).

Shi, et al., "Gibberellin and abscisic acid regulate GAST1 expression at the level of transcription," Plant Molecular Biology, vol. 38, pp. 1053-1060, (1998).

Smith, et al., "Antisense RNA inhibition of polygalacturonase gene expression in transgenic tomatoes," Nature, vol. 334, pp. 724-726, (1988).

Smith, et al., "Inheritance and effect on ripening of antisense polygalacturonase genes in transgenic tomatoes," Plant Molecular Biology, vol. 14, pp. 369-379, (1990).

Soni et al., "A Family of Cyclin D Homologs from Plants Differentially Controlled by Growth Regulators and Containing the Conserved Retinoblastoma Protein Interaction Motif," Plant Cell, vol. 7, pp. 85-103, (Jan. 1995).

Sorrell et al., "A WEE1 homologue from Arabidopsis thaliana," Planta, vol. 215, pp. 518-522, (2002).

Stals et al., "When plant cells decide to divide," Trends in Plant Science, vol. 6, No. 8, pp. 359-364, (Aug. 2001).

Stein et al., "Differential display technology: a general guide," CMLS, Cellular and Molecular Life Science, vol. 59, pp. 1235-1240, (2002).

Sterky, et al., "Gene discovery in the wood-forming tissues of poplar: Analysis of 5,692 expressed sequence tags," Proc. Natl. Acad. Sci. U.S.A., vol. 95, pp. 13330-13335, (Oct. 1998).

Subrahmanyam, et al., "RNA expression patterns change dramatically in human neutrophils exposed to bacteria," Blood, vol. 97, No. 8., pp. 2457-2468, (2001).

Sun et al., "Characterization of maize (Zea mays L) Wee1 and its activity in developing endosperm," Proc. Natl. Acad. Sci. U.S.A., vol. 96, pp. 4180-4185, (Mar. 1999).

Svab et al., "Stable transformation of plastids in higher plants," Proc. Natl. Acad. Sci. USA, vol. 87, pp. 8526-8530, (Nov. 1990).

Thibaud-Nissen, et al., "Clustering of Microarray Data Reveals Transcript Patterns Associated with Somatic Embroyogenesis in Soybean[1][w]," Plant physiology, vol. 132, pp. 118-136, (2003).

Tian et al., "Blocking histone deacetylation in Arabidopsis induces pleiotropic effects on plant gene regulation and development," Proc. Natl. Acad. Sci. U.S.A., vol. 98, No. 1, pp. 200-205, (Jan. 2, 2001).

Tian et al., "Genetic Control of Developmental Changes Induced by Disruption of Arabidopsis histone Deacetylase 1 (AtHD1) Expression," Genetics, vol. 165, pp. 399-409, (Sep. 2003).

Tuschl, "Expanding small RNA interference," Nature Biotechnology, vol. 20, pp. 446-448, (May 2002).

Tuschl, "RNA Interference and Small Interfering RNAs," Chembiochem, vol. 2, pp. 239-245, (2001).

Umeda et al., "A cyclin-dependent kinase-activating kinase regulates differentiation of root initial cells in Arabidopsis," Proc. Nat'l Acad. Sci. U.S.A., vol. 97, No. 24, pp. 13395-13400, (Nov. 21, 1990).

Umen et al., "Control of cell division by a retinoblastoma protein homolog in Chlamydomonas," Genes & Development, vol. 15, pp. 1652-1661, (2001).

Vandesompele et al., "Accurate normalization of real-time quantitative RT-PCR data by geometric averaging of multiple internatl control genes," Genome Biol., 3: research/0034.1, 12 pages., (2002).

Viaud et al., "A Magnaporthe grisea Cyclophilin Acts as a Virulence Determinant during Plant Infection," Plant Cell, vol. 14, pp. 917-930, (Apr. 2002).

Wang et al., "A plant cyclin-dependent kinase inhibitor gene," Nature, vol. 386, pp. 451-452, (Apr. 3, 1997).

Wang et al., "Expression of the plant cyclin-dependent kinase inhibitor ICK1 affects cell division, plant growth and morphology," Plant Journal, vol. 20, No. 5, pp. 613-623, (2000).

Wang et al., "Non-destructive Evaluations of Trees," Experimental Techniques, vol. 24, No. 6, pp. 27-29, (Nov./Dec. 2000).

Whetten, et al., "Functional genomics and cell wall biosynthesis in loblolly pine," Plant Molecular Biology, vol. 47, pp. 275-291, (2001).

Wildt et al., "Antibody arrays for high-throughput screening of antibody-antigen interactions," Nature Biotechnology, vol. 18, pp. 989-994, (Sep. 2000).

Xie et al., "Plant cells contain a novel member of the retinoblastoma family of growth regulatory proteins," EMBO Journal, 1996, vol. 15, No. 18, pp. 4900-4908.

Yamaguchi et al., "Activation of CDK-activating kinase is dependent on interaction with H-type cyclins in plants," Plant Journal, vol. 24(1), pp. 11-20, (2000).

Yamaguchi et al., "Control of in vitro organogenesis by cyclin-dependent kinase activities in plants," Proc. Natl. Acad. Sci. U.S.A., vol. 100, No. 13, pp. 8013-8023, (Jun. 24, 2003).

Ye, et al., "Determionation of $S_2$ fibril-angle and fiber-wall thickness by microscopic transmission ellipsometry," Tappi Journal, vol. 80, No. 6, pp. 181-190, (Jun. 1997).

Zhou et al., "Effects of co-expressing the plant CDK inhibitor ICK1 and D-type cyclin genes on plant growth, cell size and ploidy in Arabidopsis thaliana," Planta, vol. 216, pp. 604-613, (2003).

Feiler et al., "Cell division in higher plants: a cdc2 gene, its 34-kDa product, and histone H1 Kinase activity in pea," Proc. Natl. Acad. Sci., vol. 87, No. 14, Jul. 1990, pp. 5397-5401.

Tuominen, et al., "Altered Growth and Wood Characteristics in Transgenic Hybrid Aspen Expressing Agrobacterium tumefaciens T-DNA Indoleacetic Acid-Biosynthetic Genes," Plant Physiol., vol. 109, No. 4, Dec. 1995, pp. 1179-1189.

LaPierre, et al., "Structural Alterations of Lignins in Transgenic Poplars with Depressed Cinnamyl Alcohol Dehydrogenase or Caffeic Acid O-Methyltransferase Activity Have an Opposite Impact on the Efficiency of Industrial Kraft Pulping," Plant Physiology, vol. 119, No. 1, Jan. 1999, pp. 153-164.

Database Geneseq on STIC, Thomson Derwent, (London, UK), Accession No. AAC83107, Helentjaris TG et al., Gene Sequence, Feb. 23, 2001.

Database Geneseq on STIC, Thomson Derwent, (London, UK), Accession No. AAF74214, Yamada A et al., Gene Sequence, May 2, 2001.

Magyar, Z., et al., "Cell cycle phase specificity of putative cyclin-dependent kinase variants in synchronized alfalfa cells", Plant Cell, American Society of Plant Physiologists, vol. 9, No. 9, Jan. 22, 1997, pp. 223-235, Database EMBL, XP002418715.

Database UniProt, May 1, 2001, XP002418716.

* cited by examiner

FIGURE 1. Exemplary Microarray Sampling Parameters.

MODIFICATIONS OF PLANT TRAITS USING CYCLIN A

CROSS REFERENCE TO RELATED APPLICATION

This application claims priority to U.S. provisional application Ser. No. 60/533,036, filed on Dec. 30, 2003, which is specifically incorporated in its entirety herein by reference.

SEQUENCE LISTING

The instant application contains a "lengthy" Sequence Listing which has been submitted via CD-R in lieu of a printed paper copy, and is hereby incorporated by reference in its entirety. Said CD-R, recorded on May 12, 2005, are labeled "CRF", "Copy 1" and "Copy 2", respectively, and each contains only one identical 1.63 MB file (44463360.APP).

FIELD OF THE INVENTION

The present invention relates generally to the field of plant cell cycle genes and polypeptides encoded by such genes, and the use of such polynucleotide and polypeptide sequences for regulating a plant cell cycle. The invention specifically provides cell cycle polynucleotide and polypeptide sequences isolated from *Eucalyptus* and *Pinus* and sequences related thereto.

BACKGROUND OF THE INVENTION

Cell growth and division are controlled by the temporal expression of different sets of genes, allowing the dividing cell to progress through the different phases of the cell cycle. Continued growth and organogesis in plants requires precise function of the cell cycle machinery. Plant development, which is directly affected by cell division rates and patterns, also is influenced by environmental factors, such as temperature, nutrient availability, light, etc. See Gastal and Nelon, *Plant Physiol.* 105:191-7 (1994), Ben-Haj-Sahal and Tardieu, *Plant Physiol.* 109:861-7 (1995), and Sacks et al., *Plant Physiol.* 114:519-27 (1997). Plant development and phenotype are connected with the cell cycle, and altering expression of the genes involved in the cell cycle can be a useful method of modifying plant development and altering plant phenotype.

The ability to alter expression of cell cycle genes is extremely powerful because the cell cycle drives plant development, including growth rates, responses to environmental cues, and resulting plant phenotype. Control of the plant cell cycle and phenotypes associated with alteration of cell cycle gene expression, in the vascular cambium, in particular, has applications for, inter alia, alteration of wood properties and, in particular, lumber and wood pulp properties. For example, improvements to wood pulp that can be effected by altering cell cycle gene expression include increased or decreased lignin and cellulose content, and altered length, diameter, and lumen diameter of cells. Manipulating the plant cell cycle, and in particular the cambium cell cycle (i.e. the rate and angle of cell division), can also engineer better lumber having increased dimensional stability, increased tensile strength, increased shear strength, increased compression strength, increased shock resistance, increased stiffness, increased or decreased hardness, decreased spirality, decreased shrinkage, and desirable characteristics with respect to weight, density, and specific gravity.

A. Cell Cycle Genes and Proteins

1. Cyclin Dependent Protein Kinase

Progression through the cell cycle is regulated primarily by cyclin-dependent kinases (CDKs). CDKs are a conserved family of eukaryotic serine/threonine protein kinases, which require heterodimer formation with a cyclin subunit for activity. For review see, e.g. Joubes et al., *Plant Mol. Biol.* 43: 607-20 (2000), Stals and Inze, Trends Plant Sci. 6:359-64 (2001), and John et al., *Protoplasma* 216: 119-42 (2001).

The are five subclasses of CDK's, each having a different cyclin binding consensus sequence. In CDK type A the cyclin binding consensus sequence is PSTAIRE (SEQ ID NO: 778). Id. The cyclin binding consensus sequence in CDK types B-1, B-2, and C are PPTTLRE (SEQ ID NO: 779), PPTALRE (SEQ ID NO: 780), and PITAIRE (SEQ ID NO: 781), respectively. Joubes et al, *Plant Physiol,* 126: 1403-15 (2001).

Cell cycle progression is directed, in part, by changes in CDK activity. CDK activity is modulated by a number of different cell cycle protein components, such as changes in the abundance of individual cyclins due to changing rates of biosynthesis and proteolysis. Fluctuations in cyclin concentrations result in commensurate fluctuations in CDK activity. Cyclin accumulation is especially important in terminating the G1 phase of the cell cycle because DNA replication is initiated by an increase in CDK activity.

Activation of CDK also requires phosphorylation of a threonine residue within the T-loop of CDK by a CDK-activating kinase (CAK). Umeda et al., *Proc. Nat'l Acad. Sci. U.S.A.* 97: 13396-400 (2000). It was suggested by Yamaguchi et al., *Plant J.* 24: 11-20 (2000), that cyclin H is a regulatory subunit of CAK. CDK activity is further regulated by interaction with a CDK regulatory subunit, a small (70-100 AA) protein involved in cell cycle regulation.

A cell must exit the cell cycle in order to commit to differentiation, senescence or apoptosis. This process involves the down-regulation of CDK activities. CDK inhibitors (CKI) are low molecular weight proteins, which are important for cell cycle regulation and development. CKIs bind stoichiometrically to CDK and down-regulate the activity of CDKs.

Many biochemical properties of ICK1, the first plant CKI to be identified from *Arabidopsis thaliana*, are known. Wang et al., *Nature* 386:451-2 (1997) Wang et al., *Plant J.* 24: 613-23 (2000). ICK1 is expressed at low levels in many tissue types, and there can be a threshold level of ICK1 that must be overcome before a cell can enter the cell cycle. Wang et al., *Plant J.* 24: 613-23 (2000). ICK1 is induced by the plant growth regulator abscisic acid (ABA), which inhibits cell division by blocking DNA replication. When the expression of ICK 1 increases, there is a corresponding decrease in Cdc2-like H1 histone activity. ICK1 has been shown to bind in vitro with the cyclins C2c2a and CycD3, and deletion experiments have identified different domain regions for these two interactions.

Altering the expression of CDK regulatory protein or a subunit thereof is known to cause changes in plant phenotype. Overexpression of the *Arabidopsis* CDK regulatory subunit, CKS1At, resulted in a reduction of leaf size, root growth rates and meristem size. Additionally, overexpression of CKS1At resulted in inhibition of cell-cycle progression, with an extension in the duration of the G1 and G2 phases of the cell cycle.

2. Cyclins

Cyclins are positive regulatory subunits of cyclin-dependent kinase (CDK) enzymes and are required for CDK activity. Fowler et al., *Mol. Biotech.* 10, 123, 126. Cyclins and CDK complexes provide temporal regulation of transition through the cell cycle. Evidence also suggests that cyclins provide spatial regulation of specific CDK activity, differentially targeting the cytoskeleton, spindle, phragmoplast, nuclear envelope, and chromosomes.

Plant cyclins are classified into five major groups: A, B, C, D, and H. Renaudin et al., *Plant Mol. Biol.* 32: 1003-18 (1996) and Yamaguchi et al., (supra 2000). Cyclins can be divided into mitotic cyclins (A and B) and $G_1$ cyclins.

The mitotic cyclins possess a consensus sequence (R-x-x-L-x-x-I-x-N. SEQ ID NO: 782) located at the N-terminal region, termed a destruction box, adjacent to a lysine-rich region. The destruction box and lysine-rich region target the mitotic cyclins for ubiquitin-dependent proteolysis during mitosis. Stals, supra at 361, and Fowler, supra at 126. The destruction box in A versus B cyclins differs slightly and this difference is thought to result in slightly different timing of degradation of A versus B cyclins. Fowler, supra at 126. A-type cyclins accumulate during the S, G2, and early M phase of the cell cycle, whereas B-type cyclins accumulate during the late G2 and early M phase. Mironov et al., *Plant Cell* 11: 509-22 (1999). Three subgroups of A-type cyclins are known in plants, but only one is known in animals. Cyclin A1 (cycA1;zm;1 from *Zea cans*) is most concentrated during cytokinesis at the microtubule-containing phragmoplast. Expression of cyclin A2 is upregulated by auxins in roots, and by cytokinins in the shoot apex. Abrahams et al., *Biochim. Biophys. Acta* 28: 1-2 (2001).

D-type cyclins, of which five subgroups are known, are thought to control the progression through the G1 phase in response to growth factors and nutrients. Riou-Khamlichi et al., *Mol. Cell Biol.* 20: 4513-21 (2000). For example, the expression of D-type cyclins is upregulated by sucrose as shown by an increase in cycD2 mRNA 30 minutes after sucrose exposure, and an increase in cycD3 four hours after sucrose exposure. This timing corresponds to early G1-phase and late G1-phase, respectively. Cockcroft et al., *Nature* 405: 575-9 (2000). Furthermore, in *Arabidopsis*, a D3 cyclin was shown to be upregulated by the brassinosteroid, epi-brassinolide.

Cyclin D2 proteins bind with CDKA to produce an active complex, which binds to and phosphorylates retinoblastoma-related protein (Rb). This process is found in actively proliferating tissue, suggesting it plays an important function during late G1- and early S-phase. Three different D3-type cyclins are active during tomato fruit development. These proteins all contain a retinoblastoma binding motif and a PEST-destruction motif. There are differences in the spatial and temporal expression of these D3 cyclins, inferring different roles during fruit development.

Overexpression of cyclin D was shown to increase overall growth rate. Over-expression of cyclin D2 in tobacco increases causes shortening the G1-phase which producing a faster rate of cell cycling.

C- and H-type cyclins were characterized in poplar (*Populus tremula xtremuloides*) and rice (*Oryza sativa*) but their exact function is still unclear. Putative cyclins with a lesser degree of peptide sequence conservation have also been identified. For example, *Arabidopsis* CycJ18 has only 20% identity with homologues over the cyclin box domain. CycJ18 is expressed predominantly in young seedlings. *Arabidopsis* F3O9.13 protein also has similarity to the cyclin family.

3. Histone Acetyltransferase/Deacetyltransferase

Histone acetyltransferase (HA) and histone deacetyltransferase (HAD) control the net level of acetylation of histones. Histone acetylation and deacetylation are thought to exert their regulatory effects on gene expression by altering the accessibility of nucleosomal DNA to DNA-binding transcriptional activators, other chromatin-modifying enzymes or multi-subunit chromatin remodeling complexes capable of displacing nucleosomes. Lusser et al., *Nucleic Acids Res.* 27: 4427-35 (1999). Therefore, in general, the HDAs are involved in the repression of gene expression, while HAs are correlated with gene activation.

HA effects acetylation at the ε-amino group of conserved lysine residues clustered near the amino terminus of core histones which up-regulates gene expression.

HDAs remove acetyl groups from the core histones of the nucleosome. There are numerous family members in the HDA group, many of which are conserved throughout evolution. Lechner et al., *Biochim Biophys Acta* 5:181-8 (1996). HDAs fimction as part of multi-protein complexes facilitating chromatin condensation.

HDAs and HAs recognize highly distinct acetylation patterns on the nucleosome. It is thought that different types of HDAs interact with specific regions of the genome, to influence gene silencing.

Schultz et al., *Genes Dev.* 15: 428-43 (2001), demonstrated that the superfamily of Kruppel-associated-box zinc finger proteins (KRAB-ZFPs) are linked to the nucleosome remodelling and histone deacetylation complex via the PHD (plant homeodomain) and bromodomains of co-repressor KAP-1, to form a cooperative unit that is required for transcriptional repression. A maize HDAC (HD2) has been identified that has no sequence homology to other eukaryotic HDACs, but instead contains sequence similarity to peptidyl-prolyl cis-trans isomerases (PPIases).

The effects of interfering with histone deacetylation are discussed in e.g. Tian and Chen, *Proc. Nat'l Acad. Sci. USA* 98: 200-5 (2001).

4. Peptidyl Prolyl Cis-Trans Isomerase

Peptidylprolyl isomerases (e.g., peptidylprolyl cis-trans isomerase, peptidyl-prolyl cis-trans isomerase, PPIase, rotamase, cyclophilin) catalyze the interconversion of peptide bonds between the cis and trans conformations at proline residues. Sheldon and Venis, *Biochem J.* 315: 965-70 (1996). This interconversion is thought to be the rate limiting step of protein folding. PPIases belong to a conserved family of proteins that are present in animals, fungi, bacteria and plants. PPIases are implicated in a number of responses including the response to environmental stress, calcium signals, transcriptional repression, cell cycle control, etc. Viaud, et al., *Plant Cell* 14: 917-30 (2002).

5. Retinoblastoma-Related Protein

Retinoblastoma (Rb)-related protein putatively regulates progression of the cell cycle through the G1 phase and into S phase. Xie et al., *EMBO J.* 15: 4900-8 (1996) and Ach et al., *Mol. Cell Biol.* 17: 5077-86 (1997).

Although Rb is well-characterized in mammalian systems, the role of Rb-related proteins in regulation of G1 phase progression and S phase entry is not well characterized in plants. It is known, however, that RB-related protein functions through its association with various other cellular proteins involved in cell cycle regulation, such as the cyclins, WD40 proteins, Soni et al., *Plant. Cell.* 7:85-103 (1995); Grafi et al., *Proc. Natl. Acad. Sci. U.S.A.* 93:8962 (1996); Ach et al., *Plant Cell* 9:1595-606 (1997); Umen and Goodenough, *Genes Dev.* 15:1652-61 (2001); Mariconti et al., *J. Biol. Chem.* 277:9911-9 (2002).

6. WD40 Repeat Protein

WD40 is a common repeating motif involved in many different protein-protein interactions. The WD40 domain is found in proteins having a wide variety of functions including adaptor/regulatory modules in signal transduction, pre-mRNA processing and cytoskeleton assembly. Goh et al., *Eur. J. Biochem.* 267: 434-49 (2000).

The WD40 domain, which is 40 residues long, typically contains a GH dipeptide 11-24 residues from the N-terminus and the WD dipeptide at the C-terminus. Id. Between the GH dipeptide and the WD dipeptide lies a conserved core which serves as a stable platform where proteins can bind either stably or reversibly. The core forms a propeller-like structure with several blades. Each blade is composed of a four-stranded anti-parallel β-sheet. Each WD40 sequence repeat forms the first three strands of one blade and the last strand in the next blade. The last C-terminal WD40 repeat completes the blade structure of the first WD40 repeat to create the closed ring propeller-structure. The residues on the top and bottom surface of the propeller are proposed to coordinate interactions with other proteins and/or small ligands.

Studies in yeast demonstrated that Cdc20, which contains the WD40 motif, is required for the proteolysis of mitotic cyclins. This process is mediated by an ubiquitin-protein ligase called anaphase-promoting complex (APC) or cyclosome. Following ubiquitination and proteolysis by the 26S proteasome, the cell can segregate chromosomes, and exit from mitosis. Cdc20 also contains a destruction-box domain.

7. WEE1-Like Protein

WEE1 controls the activity of cyclin-dependent kinases. WEE1 itself is a serine/threonine kinase. Sorrell et al., *Planta* 215: 518-22 (2002). The enzymatic activity of these protein kinases is controlled by phosphorylation of specific residues in the activation segment of the catalytic domain, sometimes combined with reversible conformational changes in the C-terminal autoregulatory tail. This process is conserved among eukaryotes, from fungi to animals and plants. Similarly, there is a high degree of homology between WEE1 proteins from various organisms. For example, there is 50% identity between the protein kinase domains of the human and maize WEE1 proteins.

Expression of WEE1 is shown to occur only in actively dividing tissues and is believed to inhibit cell division by acting as a negative regulator of mitosis. WEE1 is believed to prevent entry from G2 to M by protecting the nucleus from cytoplasmically-activated cyclin B1-complexed CDC2 before the onset of mitosis. For example, over-expression of AtWEE1 (from *Arabidopsis*) and ZmWEE1 (from *Zea cans*) in fission yeast inhibits cell division which results in elongated cells. Sun et al., *Proc. Nat'l Acad. Sci.* USA 96: 4180-5 (1999).

B. Expression Profiling and Microarray Analysis in Plant Development

The multigenic control of plant phenotype presents difficulties in determining the genes responsible for phenotypic determination. One major obstacle to identifying genes and gene expression differences that contribute to phenotype in plants is the difficulty with which the expression of more than a handful of genes can be studied concurrently. Another difficulty in identifying and understanding gene expression and the interrelationship of the genes that contribute to plant phenotype is the high degree of sensitivity to environmental factors that plants demonstrate.

There have been recent advances using genome-wide expression profiling. In particular, the use of DNA microarrays has been useful to examine the expression of a large number of genes in a single experiment. Several studies of plant gene responses to developmental and environmental stimuli have been conducted using expression profiling. For example, microarray analysis was employed to study gene expression during fruit ripening in strawberry, Aharoni et al., *Plant Physiol.* 129:1019-1031 (2002), wound response in *Arabodopsis*, Cheong et al., *Plant Physiol.* 129:661-7 (2002), pathogen response in *Arabodopsis*, Schenk et al., *Proc. Nat'l Acad. Sci.* 97:11655-60 (2000), and auxin response in soybean, Thibaud-Nissen et al., *Plant Physiol.* 132:118. Whetten et al., *Plant Mol. Biol.* 47:275-91 (2001) discloses expression profiling of cell wall biosynthetic genes in *Pinus taeda L.* using cDNA probes. Whetten et al. examined genes which were differentially expressed between differentiating juvenile and mature secondary xylem. Additionally, to determine the effect of certain environmental stimuli on gene expression, gene expression in compression wood was compared to normal wood. 156 of the 2300 elements examined showed differential expression. Whetten, supra at 285. Comparison of juvenile wood to mature wood showed 188 elements as differentially expressed. Id. at 286.

Although expression profiling and, in particular, DNA microarrays provide a convenient tool for genome-wide expression analysis, their use has been limited to organisms for which the complete genome sequence or a large cDNA collection is available. See Hertzberg et al., *Proc. Nat'l Acad. Sci.* 98:14732-7 (2001a), Hertzberg et al., *Plant J,* 25:585 (2001b). For example, Whetten, supra, states, "A more complete analysis of this interesting question awaits the completion of a larger set of both pine and poplar ESTs." Whetten et al. at 286. Furthermore, microarrays comprising cDNA or EST probes may not be able to distinguish genes of the same family because of sequence similarities among the genes. That is, cDNAs or ESTs, when used as microarray probes, may bind to more than one gene of the same family.

Methods of manipulating gene expression to yield a plant with a more desirable phenotype would be facilitated by a better understanding of cell cycle gene expression in various types of plant tissue, at different stages of plant development, and upon stimulation by different environmental cues. The ability to control plant architecture and agronomically important traits would be improved by a better understanding of how cell cycle gene expression effects formation of plant tissues, how cell cycle gene expression causes plant cells to enter or exit cell division, and how plant growth and the cell cycle are connected. Among the large number of genes, the expression of which can change during development of a plant, only a fraction are likely to effect phenotypic changes during any given stage of the plant development.

SUMMARY

Accordingly, there is a need for tools and methods useful in determining the changes in the expression of cell cycle genes that occur during the plant cell cycle. There is also a need for polynucleotides useful in such methods. There is a further need for methods which can correlate changes in cell cycle gene expression to phenotype or stage of plant development. There is a further need for methods of identifying cell cycle genes and gene products that impact plant phenotype, and that can be manipulated to obtain a desired phenotype.

In one aspect, the present invention provides an isolated polynucleotide comprising a nucleic acid sequence selected from the group consisting of SEQ ID NOs: 1-260 and conservative variants thereof.

In another aspect, the present invention provides a DNA construct comprising at least one polynucleotide having the sequence of any one of SEQ ID NOs: 1-260 and conservative variants thereof.

Another aspect of the invention is a plant cell transformed with a DNA construct of comprising a nucleic acid sequence selected from the group consisting of SEQ ID NOs: 1-260 and conservative variants thereof.

A further aspect of the invention is a transgenic plant comprising a plant cell transformed with a DNA construct comprising a nucleic acid sequence selected from the group consisting of SEQ ID NOs: 1-260 and conservative variants thereof.

Another aspect of the invention is an isolated polynucleotide comprising a sequence encoding the catalytic or substrate-binding domain of a polypeptide selected from of any one of SEQ ID NOs: 261-520, wherein the polynucleotide encodes a polypeptide having the activity of said polypeptide selected from any one of SEQ ID NOs: 261-520.

A further aspect of the invention is a method of making a transformed plant comprising transforming a plant cell with a DNA construct comprising at least one polynucleotide having the sequence of any of SEQ ID NOs: 1-260; and culturing the transformed plant cell under conditions that promote growth of a plant.

In another aspect, the invention provides a wood obtained from a transgenic tree.

In a further aspect, the invention provides a wood pulp obtained from a transgenic tree which has been transformed with the DNA construct of the invention.

Another aspect of the invention is a method of making wood, comprising transforming a plant with a DNA construct comprising a polynucleotide having a nucleic acid sequence selected from the group consisting of SEQ ID NOs: 1-260 and conservative variants thereof; culturing the transformed plant under conditions that promote growth of a plant; and obtaining wood from the plant.

The invention further provides a method of making wood pulp, comprising transforming a plant with a DNA construct comprising a polynucleotide having a nucleic acid sequence selected from the group consisting of SEQ ID NOs: 1-260 and conservative variants thereof; culturing the transformed plant under conditions that promote growth of a plant; and obtaining wood pulp from the plant.

In another aspect, the invention provides an isolated polypeptide comprising an amino acid sequence encoded by the isolated polynucleotide comprising a nucleic acid sequence selected from the group consisting of SEQ ID NOs: 1-260 and conservative variants thereof.

The invention also provides, an isolated polypeptide comprising an amino acid sequence selected from the group consisting of 261-520.

The invention further provides a method of altering a plant phenotype of a plant, comprising altering expression in the plant of a polypeptide encoded by any one of SEQ ID NOs: 1-260.

In another aspect, the invention provides a polynucleotide comprising a nucleic acid selected from the group comprising of SEQ ID NOs: 521-772.

An aspect of the invention is a method of correlating gene expression in two different samples, comprising detecting a level of expression of one or more genes encoding a product encoded by a nucleic acid sequence selected from the group consisting of SEQ ID NOs: 1-260 and conservative variants thereof in a first sample; detecting a level of expression of the one or more genes in a second sample; comparing the level of expression of the one or more genes in the first sample to the level of expression of the one or more genes in the second sample; and correlating a difference in expression level of the one or more genes between the first and second samples.

A further aspect of the invention is a method of correlating the possession of a plant phenotype to the level of gene expression in the plant of one or more genes comprising detecting a level of expression of one or more genes encoding a product encoded by a nucleic acid sequence selected from the group consisting of SEQ ID NOs: 1-260 and conservative variants thereof in a first plant possessing a phenotype; detecting a level of expression of the one or more genes in a second plant lacking the phenotype; comparing the level of expression of the one or more genes in the first plant to the level of expression of the one or more genes in the second plant; and correlating a difference in expression level of the one or more genes between the first and second plants to possession of the phenotype.

In a further aspect, the invention provides a method of correlating gene expression to a stage of the cell cycle, comprising detecting a level of expression of one or more genes encoding a product encoded by a nucleic acid sequence selected from the group consisting of SEQ ID NOs: 1-260 and conservative variants thereof in a first plant cell in a first stage of the cell cycle; detecting a level of expression of the one or more genes in a second plant cell in a second, different stage of the cell cycle; comparing the level of the expression of the one or more genes in the first plant cells to the level of expression of the one or more genes in the second plants cells; and correlating a difference in expression level of the one or more genes between the first and second samples to the first or second stage of the cell cycle.

An aspect of the invention is a combination for detecting expression of one or more genes, comprising two or more oligonucleotides, wherein each oligonucleotide is capable of hybridizing to a nucleic acid sequence selected from the group consisting of SEQ ID NOs: 1-260.

Another aspect of the invention is a combination for detecting expression of one or more genes, comprising two or more oligonucleotides, wherein each oligonucleotide is capable of hybridizing to a nucleic acid sequence encoded by a nucleic acid sequence selected from the group consisting of SEQ ID NOs: 1-260.

The invention further provides a microarray comprising a combination for detecting expression of one or more genes, comprising two or more oligonucleotides, wherein each oligonucleotide is capable of hybridizing to a nucleic acid sequence selected from the group consisting of SEQ ID NOs: 1-260 or wherein each oligonucleotide is capable of hybridizing to a nucleic acid sequence encoded by a nucleic acid sequence selected from the group consisting of SEQ ID NOs: 1-260, wherein each of said two or more oligonucleotides occupies a unique location on said solid support.

In another aspect, the invention provides a method for detecting one or more genes in a sample, comprising contacting the sample with two or more oligonucleotides, wherein each oligonucleotide is capable of hybridizing to a gene comprising a nucleic acid sequence selected from the group consisting of SEQ ID NOs: 1-260 under standard hybridization conditions; and detecting the one or more genes of interest which are hybridized to the one or more oligonucleotides.

The invention also provides a method for detecting one or more nucleic acid sequences encoded by one or more genes in a sample, comprising contacting the sample with two or more oligonucleotides, wherein each oligonucleotide is capable of hybridizing to a nucleic acid sequence encoded by a gene comprising a nucleic acid sequence selected from the group consisting of SEQ ID NOs: 1-260 under standard hybridization conditions; and detecting the one or more nucleic acid sequences which are hybridized to the one or more oligonucleotides.

The invention further provides a kit for detecting gene expression comprising the microarray of the invention together with one or more buffers or reagents for a nucleotide hybridization reaction.

Other features, objects, and advantages of the present invention are apparent from the detailed description that follows. It should be understood, however, that the detailed description, while indicating preferred embodiments of the invention, are given by way of illustration only, not limitation. Various changes and modifications within the spirit and scope of the invention will be apparent to those skilled in the art from the detailed description.

LIST OF TABLES

Figure 1:
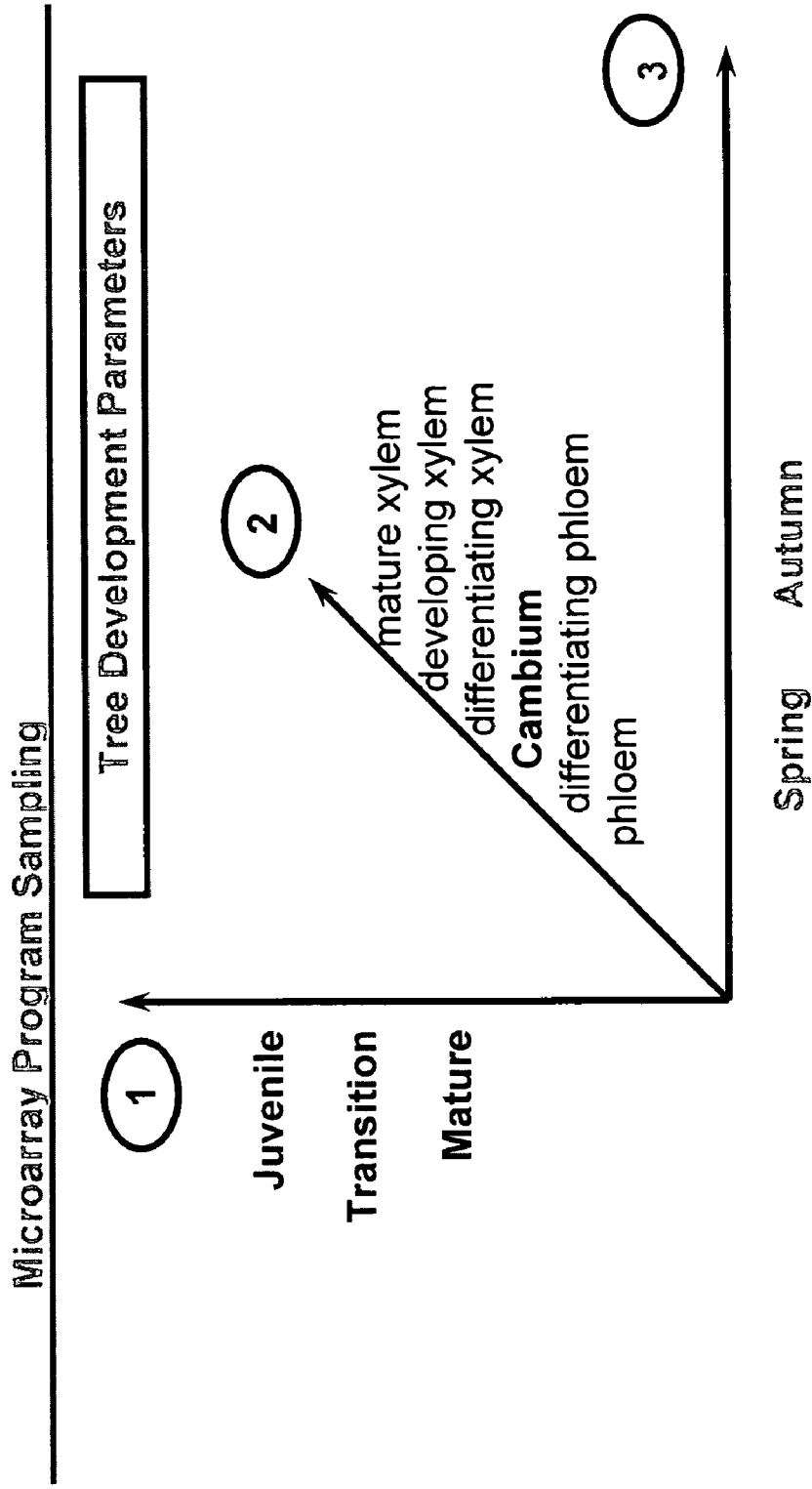
FIG. 1: Exemplary microarray sampling parameters.
Figure 2:
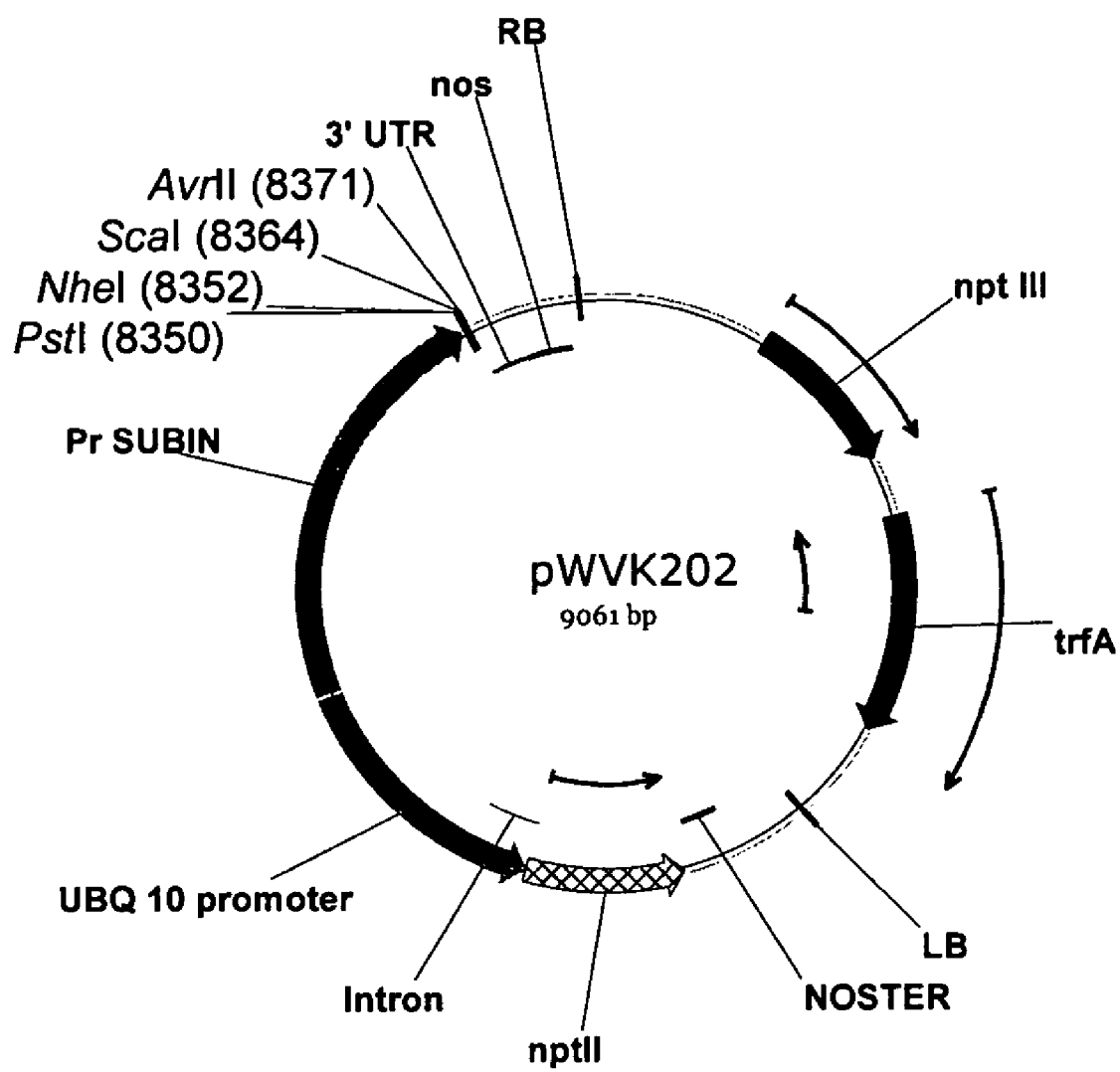
FIG. 2: Plasmid map for pWVK202.
Figure 3:
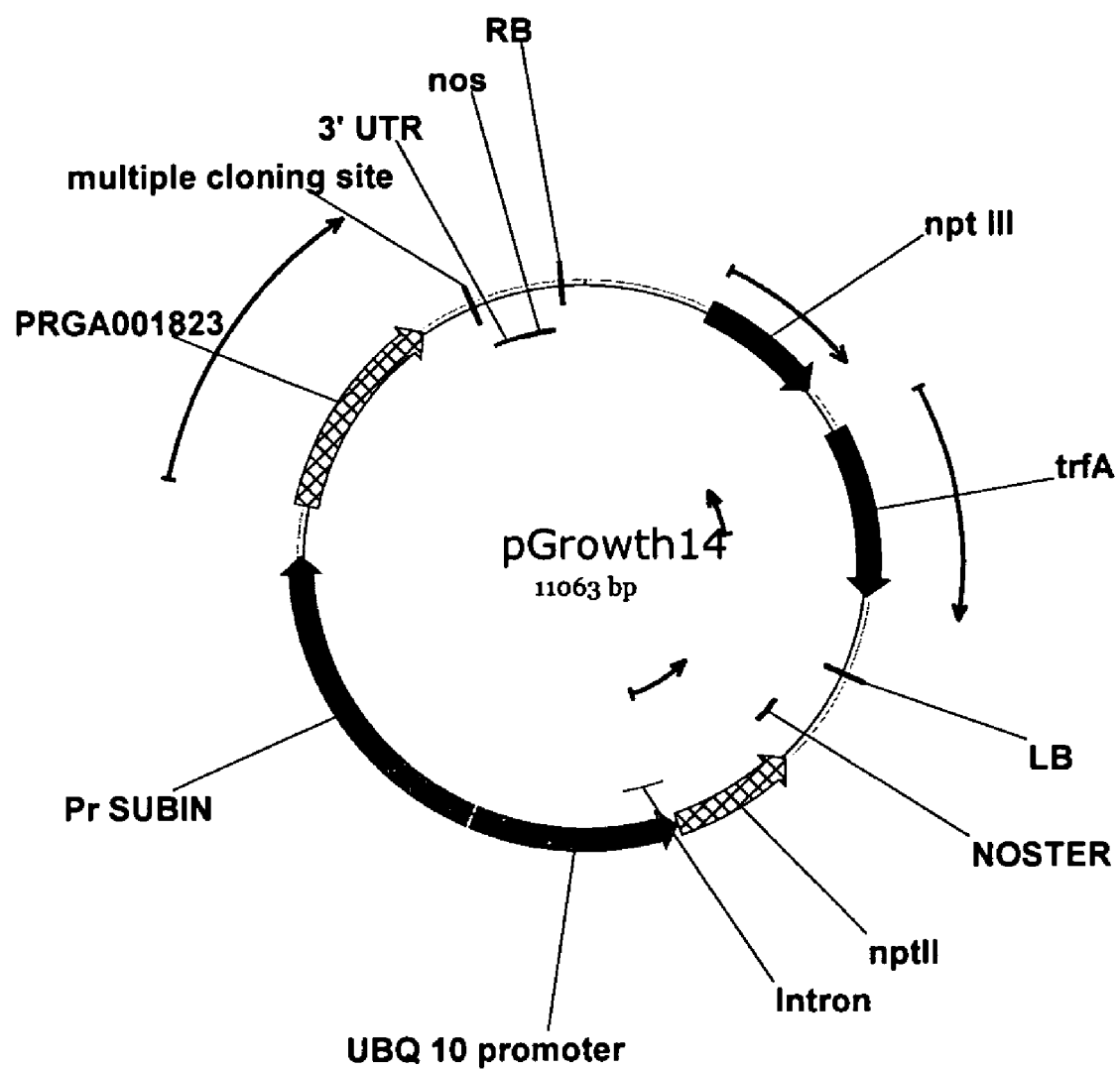
FIG. 3: Plasmid map for pGrowth14.
Figure 4:
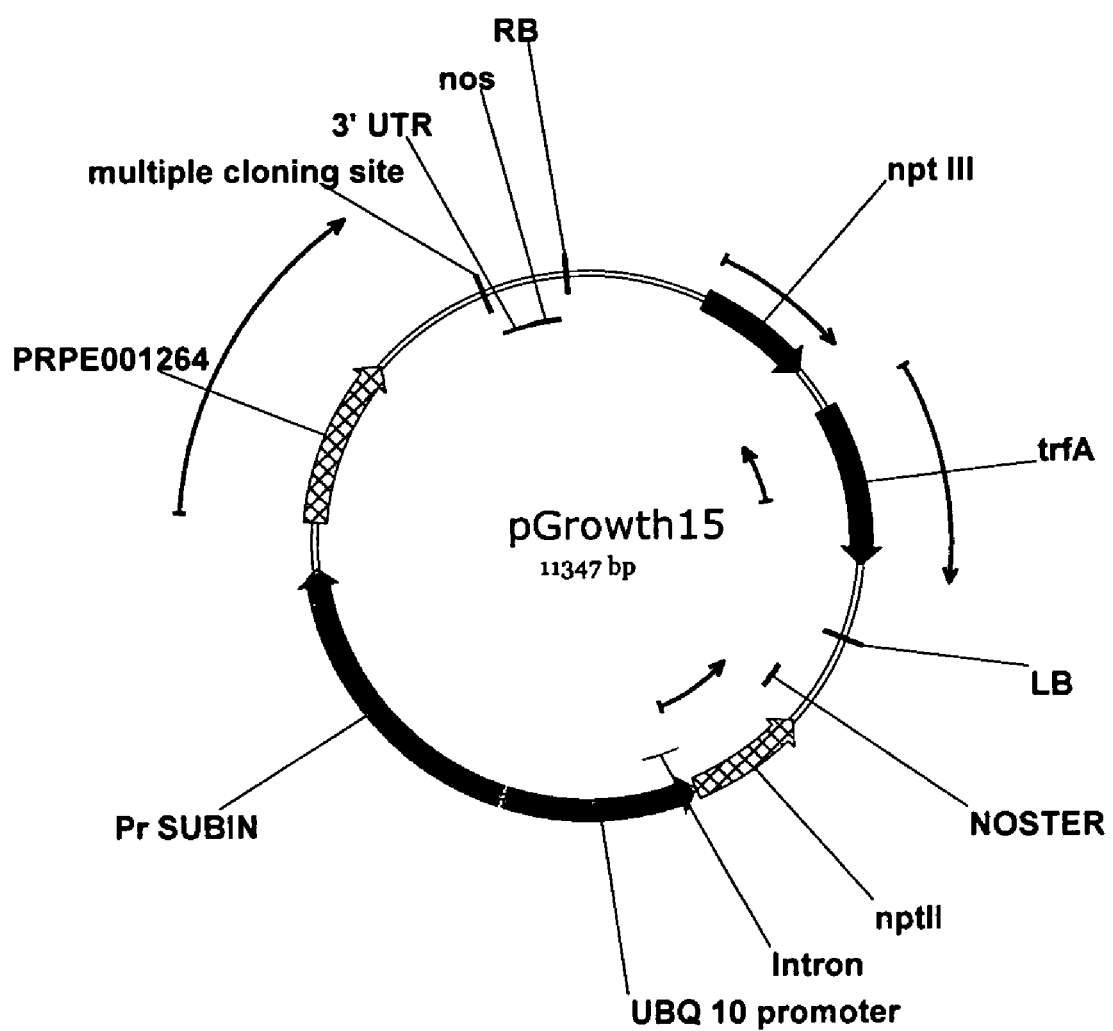
FIG. 4: Plasmid map for pGrowth15.
Figure 5:
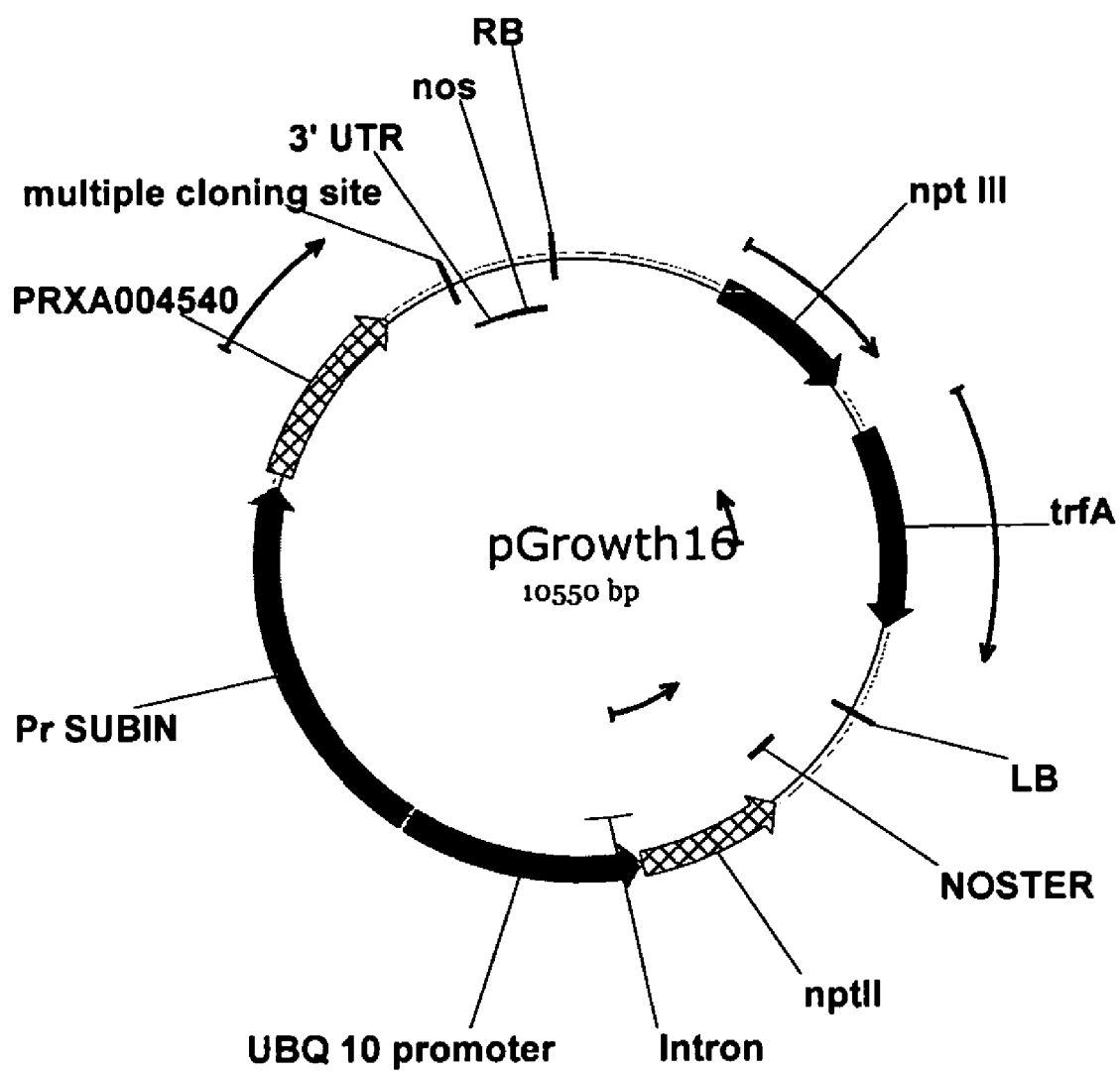
FIG. 5: Plasmid map for pGrowth16.
Figure 6:
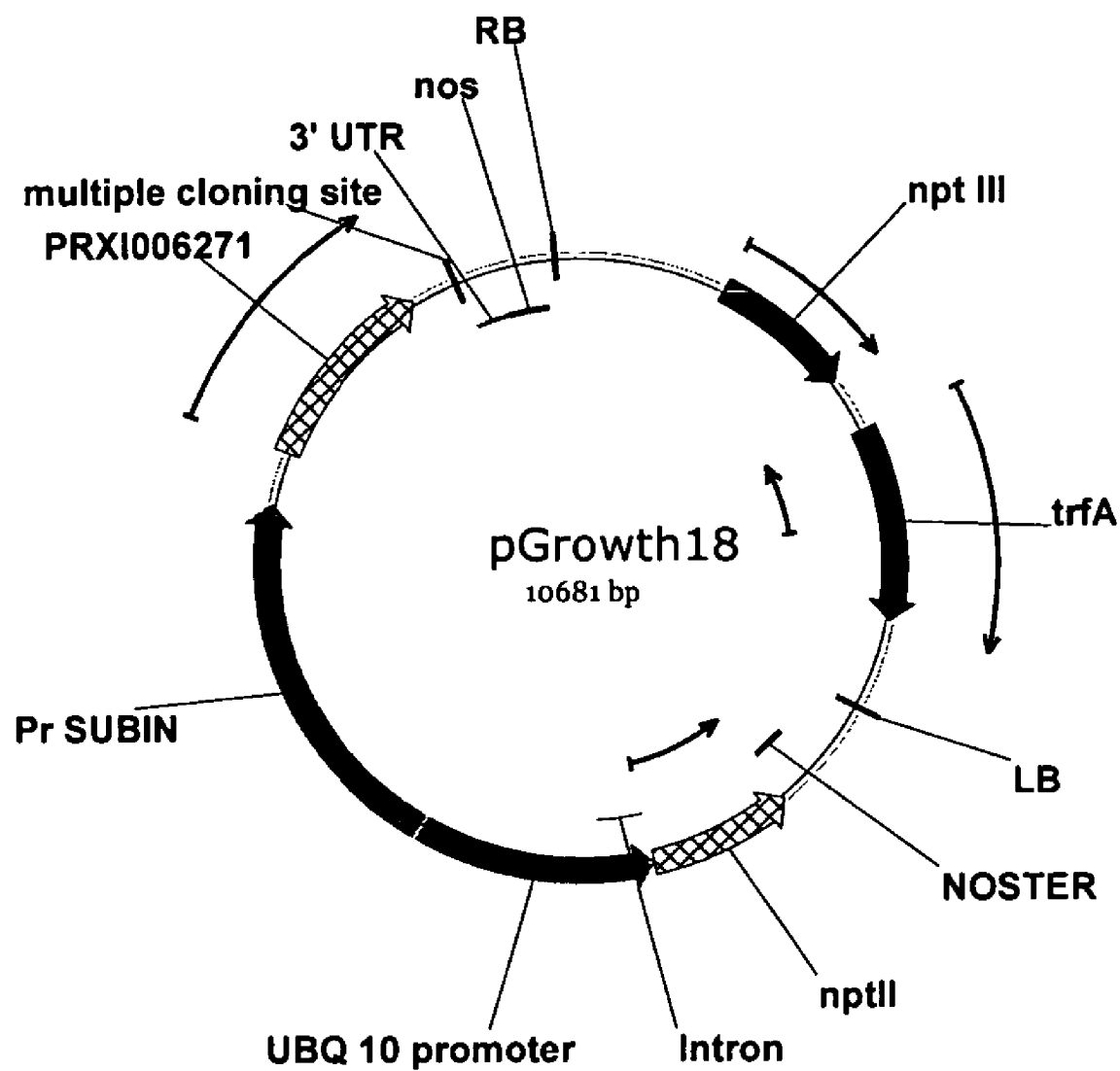
FIG. 6: Plasmid map for pGrowth18.
Figure 7:
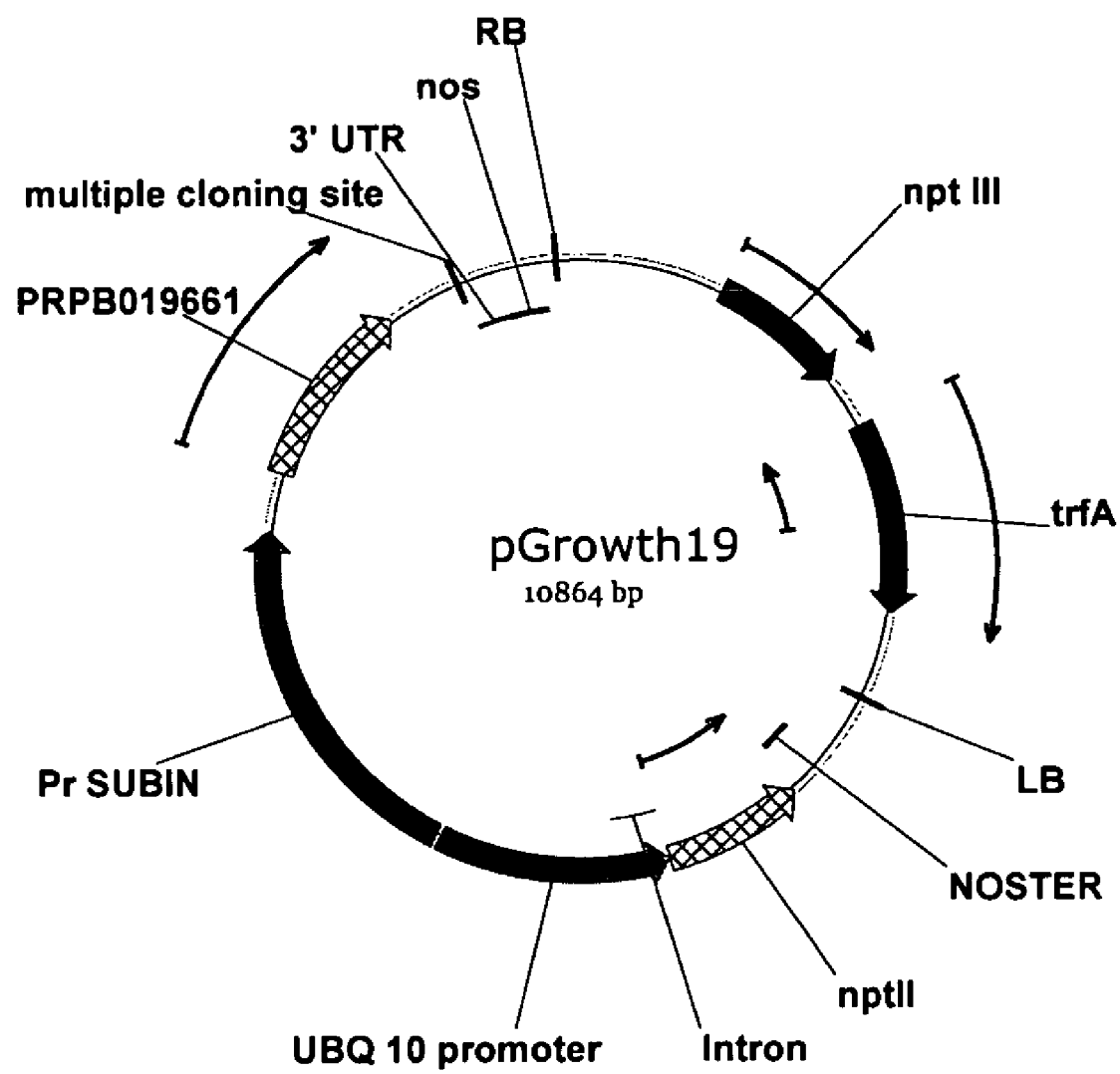
FIG. 7: Plasmid map for pGrowth19.
Figure 8:
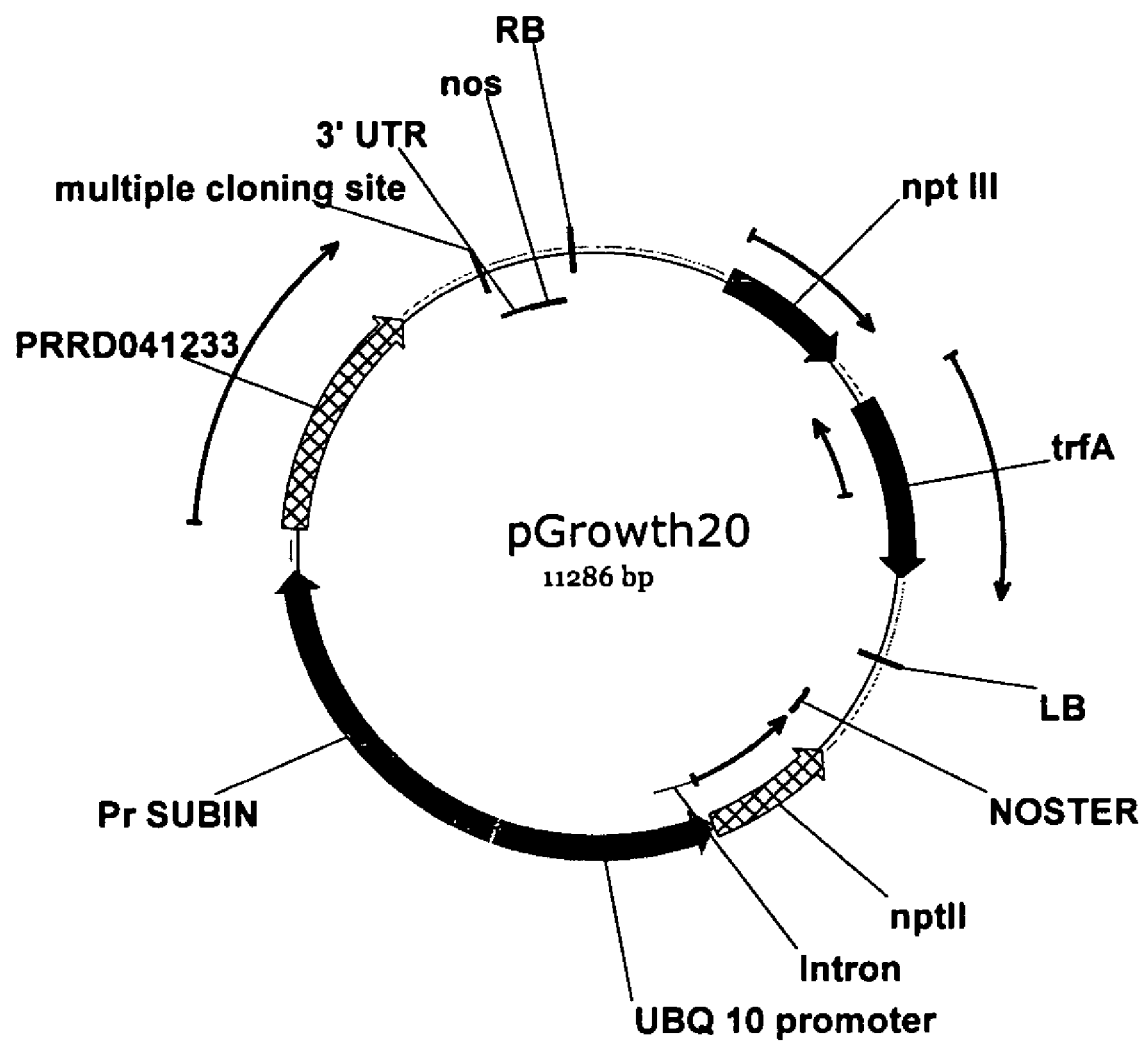
FIG. 8: Plasmid map for pGrowth20.

Table 1: shows genes having greater than doubled signal with any one sample as compared to the mean signal of the other three samples.
Table 2: identifies plasmid(s), genes, and Genesis ID numbers for constructs described in Example 17.
Table 3: Rooting medium for *Populus deltoids*.
Table 4: pGrowth information.
Table 5: shows genes having greater than doubled signal with any one sample as compared to the mean signal of the other three samples.
Table 6: Differentially expressed cDNAs.
Table 7: Consensus ID information.
Table 8: pGrowth information.
Table 9: *Eucalyptus grandis* cell cycle genes and proteins.
Table 10: *Pinus radiata* cell cycle genes and proteins.
Table 11: Annotated peptide sequences of the present invention.
Table 12: *Eucalyptus* in silico data.
Table 13: Pine in silico data.
Table 14: Oligo table.
Table 15: Peptide table.
Table 16: BLAST sequence alignment table.

DETAILED DESCRIPTION

The inventors have discovered novel isolated cell cycle genes and polynucleotides useful for identifying the multigenic factors that contribute to a phenotype and for manipulating gene expression to affect a plant phenotype. These genes, which are derived from plants of commercially important forestry genera, pine and eucalyptus, are involved in the plant cell cycle and are, at least in part, responsible for expression of phenotypic characteristics important in commercial wood, such as stiffness, strength, density, fiber dimensions, coarseness, cellulose and lignin content, and extractives content. Generally speaking, the genes and polynucleotides encode a protein which can be a cyclin, cyclin dependent kinase, cyclin dependent kinase inhibitor, histone acetyltransferase, histone deacetylase, peptidyl-prolyl cis-trans isomerase, retinoblastoma-related protein, WEE1-like protein, or WD40 repeat protein, or a catalytic domain thereof, or a polypeptide having the same function, and the invention further includes such proteins and polypeptides.

The methods of the present invention for selecting cell cycle gene sequences to target for manipulation will permit better design and control of transgenic plants with more highly engineered phenotypes. The ability to control plant architecture and agronomically important traits in commercially important forestry species will be improved by the information obtained from the methods, such as which genes affect which phenotypes, which genes affect entry into which stage of the cell cycle, which genes are active in which stage of plant development, and which genes are expressed in which tissue at a given point in the cell cycle or plant development.

Unless indicated otherwise, all technical and scientific terms are used herein in a manner that conforms to common technical usage. Generally, the nomenclature of this description and the described laboratory procedures, including cell culture, molecular genetics, and nucleic acid chemistry and hybridization, respectively, are well known and commonly employed in the art. Standard techniques are used for recombinant nucleic acid methods, oligonucleotide synthesis, cell culture, tissue culture, transformation, transfection, transduction, analytical chemistry, organic synthetic chemistry, chemical syntheses, chemical analysis, and pharmaceutical formulation and delivery. Generally, enzymatic reactions and purification and/or isolation steps are performed according to the manufacturers' specifications. Absent an indication to the contrary, the techniques and procedures in question are performed according to conventional methodology disclosed, for example, in Sambrook et al., MOLECULAR CLONING A LABORATORY MANUAL, 2d ed. (Cold Spring Harbor Laboratory Press, 1989), and CURRENT PROTOCOLS IN MOLECULAR BIOLOGY, John Wiley & Sons, 1989). Specific scientific methods relevant to the present invention are discussed in more detail below. However, this discussion is provided as an example only, and does not limit the manner in which the methods of the invention can be carried out.

A. Plant Cell Cycle Genes and Proteins
1. Cell Cycle Genes, Polynucleotide and Polypeptide Sequences One aspect of the present invention relates to novel plant cell cycle genes and polypeptides encoded by such genes. As used herein, the term "plant cell cycle genes" refers to genes encoding proteins that function during the plant cell cycle, and the term "plant cell cycle proteins" refers to proteins that function during the plant cell cycle. There are several known families of plant cell cycle proteins, including cyclin, cyclin dependent kinase, cyclin dependent kinase inhibitor, histone acetyltransferase, histone deacetylase, peptidyl-prolyl cis-trans isomerase, retinoblastoma-related protein, WEE1-like protein, and WD40 repeat protein. Although there is significant sequence homology within each gene and protein family, each member of each family can display different biochemical properties and altering the expression of at least one of these genes can result in a different plant phenotype.

The present invention provides novel plant cell cycle genes and polynucleotides and novel cell cycle proteins and polypeptides. In accordance with one embodiment of the invention, the novel plant cell cycle genes are the same as those expressed in a wild-type plant of a species of *Pinus* or *Eucalyptus*. Exemplary novel plant cell cycle gene sequences of the invention are set forth in Tables 9 and 10, which depict *Eucalyptus grandis* sequences and *Pinus radiata* sequences, respectively. Corresponding gene products, i.e., oligonucleotides and polypeptides, are also listed in Tables 14, 15, and 16. The Sequence Listing in APPENDIX 1 provides the sequences of these aspects of the invention.

The sequences of the invention have cell cycle activity and encode proteins that are active in the cell cycle, such as proteins of the cell cycle families discussed above. As discussed in more detail below, manipulation of the expression of the cell cycle genes and polynucleotides, or manipulation of the activity of the encoded proteins and polypeptides, can result in a transgenic plant with a desired phenotype that differs from the phenotype of a wild-type plant of the same species.

Throughout this description, reference is made to cell cycle gene products. As used herein, a "cell cycle gene product" is a product encoded by a cell cycle gene, and includes both nucleotide products, such as RNA, and amino acid products, such as proteins and polypeptides. Examples of specific cell cycle genes of the invention include SEQ ID NOs: 1-260. Examples of specific cell cycle gene products of the invention include products encoded by any one of SEQ ID NOs: 1-260. Reference also is made herein to cell cycle proteins and cell cycle polypeptides. Examples of specific cell cycle proteins and polypeptides of the invention include polypeptides encoded by any of SEQ ID NOs: 1-260 or polypeptides comprising the amino acid sequence of any of SEQ ID NOs: 261-520. One aspect of the invention is directed to a subset of these cell cycle genes and cell cycle gene products, namely SEQ ID NOs: 1-12, 14-58, 60-62, 64-70, 72-75, 77-83, 85-86, 88-91, 93-119, 121-130, 132-148, 150-156, 158-191, 193-207, 209-218, 220-221, 223-231, 233-237, their respective conservative variants (as that term is defined below), and the nucleotide and amino acid products encoded thereby. Another aspect of the invention is directed to a subset of the cell cycle genes and cell cycle gene products, namely SEQ ID NOs: 1-12, 14, 16-26, 30-37, 40-41, 43-76, 78-103, 106, 108-113, 116-121, 124-125, 128-147, 150-152, 154-155, 161-162, 164-172, 174, 177-183, 185-191, 193-197, 200-204, 208-213, 215-218, 220-221, 223-231, and 233-234 their respective conservative variants, and the nucleotide and amino acid products encoded thereby. A further aspect of the invention is directed to a subset of the cell cycle genes and cell cycle gene products, namely SEQ ID NOs: 1-12, 14, 16-26, 30-37, 40-41, 43-58, 60-62, 64-70, 72-75, 78-83, 85-86, 88-91, 93-103, 106, 108-113, 116-119, 121, 124-125, 128-130, 132-147, 150-152, 154-155, 161-162, 164-172, 174, 177-183, 185-191, 193-197, 200-204, 209-213, 215-218, 220-221, 223-231, and 233-234 their respective conservative variants, and the nucleotide and amino acid products encoded thereby.

The present invention also includes sequences that are complements, reverse sequences, or reverse complements to the nucleotide sequences disclosed herein.

The present invention also includes conservative variants of the sequences disclosed herein. The term "variant," as used herein, refers to a nucleotide or amino acid sequence that differs in one or more nucleotide bases or amino acid residues from the reference sequence of which it is a variant.

Thus, in one aspect, the invention includes conservative variant polynucleotides. As used herein, the term "conservative variant polynucleotide" refers to a polynucleotide that hybridizes under stringent conditions to an oligonucleotide probe that, under comparable conditions, binds to the reference gene the conservative variant is a variant of. Thus, for example, a conservative variant of SEQ ID NO: 1 hybridizes under stringent conditions to an oligonucleotide probe that, under comparable conditions, binds to SEQ ID NO: 1. One aspect of the invention provides conservative variant polynucleotides that exhibit at least about 75% sequence identity to their respective reference sequences.

"Sequence identity" has an art-recognized meaning and can be calculated using published techniques. See COMPUTATIONAL MOLECULAR BIOLOGY, Lesk, ed. (Oxford University Press, 1988), BIOCOMPUTING: INFORMATICS AND GENOME PROJECTS, Smith, ed. (Academic Press, 1993), COMPUTER ANALYSIS OF SEQUENCE DATA, PART I, Griffin & Griffin, eds., (Humana Press, 1994), SEQUENCE ANALYSIS IN MOLECULAR BIOLOGY, Von Heinje ed., Academic Press (1987), SEQUENCE ANALYSIS PRIMER, Gribskov & Devereux, eds. (Macmillan Stockton Press, 1991), and Carillo & Lipton, SIAM J. Applied Math. 48: 1073 (1988). Methods commonly employed to determine identity or similarity between two sequences include but are not limited to those disclosed in GUIDE TO HUGE COMPUTERS, Bishop, ed, (Academic Press, 1994) and Carillo & Lipton, supra. Methods to determine identity and similarity are codified in computer programs. Preferred computer program methods to determine identity and similarity between two sequences include but are not limited to the GCG program package (Devereux et al., Nucleic Acids Research 12: 387 (1984)), BLASTP, BLASTN, FASTA (Atschul et al., J. Mol. Biol. 215: 403 (1990)), and FASTDB (Brutlag et al., Comp. App. Biosci. 6: 237 (1990)).

The invention includes conservative variant polynucleotides having a sequence identity that is greater than or equal to 99%, 98%, 97%, 96%, 95%, 94%, 93%, 92%, 91%, 90%, 89%, 88%, 87%, 86%, 85%, 84%, 83%, 82%, 81%, 80%, 79%, 78%, 77%, 76%, 75%, 74%, 73%, 72%, 71%, 70%, 69%, 68%, 67%, 66%, 65%, 64%, 63%, 62%, 61%, or 60% to any one of SEQ ID NOs: 1 to 237. In such variants, differences between the variant and the reference sequence can occur at the 5' or 3' terminal positions of the reference nucleotide sequence or anywhere between those terminal positions, interspersed either individually among nucleotides in the reference sequence or in one or more contiguous groups within the reference sequence.

Additional conservative variant polynucleotides contemplated by and encompassed within the present invention include polynucleotides comprising sequences that differ from the polynucleotide sequences of SEQ ID NO: 1-237, or complements, reverse complements or reverse sequences thereof, as a result of deletions and/or insertions totaling less than 10% of the total sequence length.

The invention also includes conservative variant polynucleotides that, in addition to sharing a high degree of similarity in their primary structure (sequence) to SEQ ID NOs: 1 to 260, have at least one of the following features: (i) they contain an open reading frame or partial open reading frame encoding a polypeptide having substantially the same functional properties in the cell cycle as the polypeptide encoded by the reference polynucleotide, or (ii) they have nucleotide domains or encoded protein domains in common. The invention includes conservative variants of SEQ ID NOs: 1-260 that encode proteins having the enzyme or biological activity or binding properties of the protein encoded by the reference polynucleotide. Such conservative variants are functional variants, in that they have the enzymatic or binding activity of the protein encoded by the reference polynucleotide.

In accordance with the invention, polynucleotide variants can include a "shuffled gene" such as those described in e.g. U.S. Pat. Nos. 6,500,639, 6,500,617 6,436,675, 6,379,964, 6,352,859 6,335,198 6,326,204, and 6,287,862. A variant of a nucleotide sequence of the present invention also can be a polynucleotide modified as disclosed in U.S. Pat. No. 6,132,970, which is incorporated herein by reference.

In accordance with one embodiment, the invention provides a polynucleotide that encodes a cell cycle protein from one of the following families: cyclin, cyclin dependent kinase, cyclin dependent kinase inhibitor, histone acetyltransferase, histone deacetylase, peptidyl-prolyl cis-trans isomerase, retinoblastoma-related protein, WEE1-like protein, or WD40 repeat protein. SEQ ID NOs: 1-260 provide examples of such polynucleotides.

In accordance with another embodiment, a polynucelotide of the invention encodes the catalytic or protein binding domain of a polypeptide encoded by any of SEQ ID NOs: 1-260 or of a polypeptide comprising any of SEQ ID NOs: 261-520. The catalytic and protein binding domains of the cell cycle proteins of the invention are known in the art. The conserved sequences of these proteins are shown in Entries 1-248 as underlined, bold, and/or italicized text.

The invention also encompasses as conservative variants polynucleotides that differ from the sequences discussed above but that, as a consequence of the degeneracy of the genetic code, encode a polypeptide which is the same as that encoded by a polynucleotide of the present invention. The invention also includes as conservative variants polynucleotides comprising sequences that differ from the polynucleotide sequences discussed above as a result of substitutions that do not affect the amino acid sequence of the encoded polypeptide sequence, or that result in conservative substitutions in the encoded polypeptide sequence.

The present invention also includes an isolated polypeptide encoded by a polynucleotide comprising any of SEQ ID NOs: 1-260 or any of the conservative variants thereof discussed above. The invention also includes polypeptides comprising SEQ ID NOs: 261-520 and conservative variants of these polypeptides. Another aspect of the invention include polypeptides comprising SEQ ID NOs: 261-272, 274-318, 320-322, 324-330, 332-335, 337-343, 345-346, 348-351, 353-379, 381-390, 392-408, 410-416, 418-451, 453-467, 469-478, 480-481, 483-491, and 493-494 and conservative variants thereof. A further aspect of the invention includes polypeptides comprising SEQ ID NOs: 261-272, 274, 276-286, 289, 290-297, 300-301, 303-345, 347-363, 366, 368-373, 376-381, 384-385, 388-407, 410-412, 414-415, 420-422, 424-432, 434, 437-443, 445-451, 453-457, 460-464, 468-473, and 475-494 and conservative variants thereof. Another aspect of the invention includes polypeptides comprising SEQ ID NOs: 261-272, 274, 276-286, 290-297, 300-301, 303-318, 320-322, 324-330, 332-335, 337-343, 345, 348-351, 353-363, 366, 368-373, 376-381, 384-385, 388-390, 392-407, 410-412, 414-415, 421-422, 424-432, 434, 437-443, 445-451, 453-457, 460-464, 469-473, 475-478, 480-481, 483-491, and 493-494 and conservative variants thereof.

In accordance with the invention, a variant polypeptide or protein refers to an amino acid sequence that is altered by the addition, deletion or substitution of one or more amino acids.

The invention includes conservative variant polypeptides. As used herein, the term "conservative variant polypeptide" refers to a polypeptide that has similar structural, chemical or biological properties to the protein it is a conservative variant of. Guidance in determining which amino acid residues can be substituted, inserted, or deleted can be found using computer programs well known in the art such as Vector NTI Suite (InforMax, MD) software. In one embodiment of the invention, conservative variant polypeptides that exhibit at least about 75% sequence identity to their respective reference sequences.

Conservative variant protein includes an "isoform" or "analog" of the polypeptide. Polypeptide isoforms and analogs refers to proteins having the same physical and physiological properties and the same biological function, but whose amino acid sequences differs by one or more amino acids or whose sequence includes a non-natural amino acid.

Polypeptides comprising sequences that differ from the polypeptide sequences of SEQ ID NO: 261-520 as a result of amino acid substitutions, insertions, and/or deletions totaling less than 10% of the total sequence length are contemplated by and encompassed within the present invention.

One aspect of the invention provides conservative variant polypeptides that have the same function in the cell cycle as the proteins of which they are variants, as determined by one or more appropriate assays, such as those described below. The invention includes variant polypeptides that function as cell cycle proteins, such as those having the biological activity of cyclin, cyclin dependent kinase, cyclin dependent kinase inhibitor, histone acetyltransferase, histone deacetylase, peptidyl-prolyl cis-trans isomerase, retinoblastoma-related protein, WEE1-like protein, and WD40 repeat protein, and are thus capable of modulating the cell cycle in a plant. As discussed above, the invention includes variant polynucleotides that encode polypeptides that function as cell cycle proteins.

The activities and physical properties of cell cycle proteins can be examined using any method known in the art. The following examples of assay methods are not exhaustive and are included to provide some guidance in examining the activity and distinguishing protein characteristics of cell cycle protein variants.

CDK activity can be assessed using roscovitine as described in Yamaguchi et al., *Proc. Natl. Acad. Sci. U.S.A.* 100:8019 (2003). CDK histone kinase activity can be assayed using autoradiography to detect histone H1 phosphorylation by CDK as described in Joubes et al., *Plant Physiol.* 121:857 (1999).

CKI activity can be assayed using a variation of the method described in Zhou et al., *Planta.* 6:604 (2003). The modified method can employ co-transformation or subsequent transformations to identify the interaction of CKI and cyclins in vivo. For example, in the first transformation pine tissue can be transformed using the method described in U.S. Patent Application Publication No. 2002/0100083 using geneticin selection to obtain transgenic plants possessing cycD3 and cdc2a homologs. The second transformation can be performed using alpha-methyltryptophan as a selectable marker to obtain transformants having an ICK1 homologue as described in U.S. Provisional Application No. 60/476,189. Tissue capable of growing on both on geneticin and on alpha-methyltryptophan contains the ICK1 homologue and the cycD3 and cdc2a homologues. The CKI activity is determined by comparison of the phenotype of transformants having the cycD3 and cdc2a homologues to the transformants having ICK1 homologue and the cycD3 and cdc2a homologs.

Histone deacetylase activity can be assessed by complementation of the *Arabidopsis* mutants described in Tian et al., *Genetics* 165:399 (2003). Histone acetyltransferase activity can be assayed using anacardic acid as described in Balasubramanyam et al., *J. Biol. Chem.* 278:19134 (2003). Histone acetyltransferase also can be assayed using trichostatin A-treated plant lines as is described in Bhat et al., *Plant J.* 33:455 (2003). The plant lines described in Bhat et al., supra, also can be used to assay retinoblastoma-related proteins using the co-precipitation method described in Rossi et al., *Plant Mol. Biol.* 51:401 (2003).

Peptidyl-prolyl isomerase can be assayed as described in Edvardsson et al., *FEBS Lett.* 542:137 (2003). WD40 proteins can be evaluated based on the possession of the WD40 motif as well as their ability to interact with cdc2. WEE-1 can be assayed using any kinase activity assay known in the art.

2. Methods of Using Cell Cycle Genes, Polynucleotide and Polypeptide Sequences

The present invention provides methods of using plant cell cycle genes and conservative variants thereof. The invention includes methods and constructs for altering expression of plant cell cycle genes and/or gene products for purposes including, but not limited to (i) investigating function during the cell cycle and ultimate effect on plant phenotype and (ii) to effect a change in plant phenotype. For example, the invention includes methods and tools for modifying wood quality, fiber development, cell wall polysaccharide content, fruit ripening, and plant growth and yield by altering expression of one or more plant cell cycle genes.

The invention comprises methods of altering the expression of any of the cell cycle genes and variants discussed above. Thus, for example, the invention comprises altering expression of a cell cycle gene present in the genome of a wild-type plant of a species of *Eucalyptus* or *Pinus*. In one embodiment, the cell cycle gene comprises a nucleotide sequence selected from SEQ ID NOs: 1-260, from the subset thereof comprising SEQ ID NOs: 1-12, 14-58, 60-62, 64-70, 72-75, 77-83, 85-86, 88-91, 93-119, 121-130, 132-148, 150-156, 158-191, 193-207, 209-218, 220-221, 223-231, and 233-237, from the subset thereof comprising SEQ ID NOs: 1-12, 14, 16-26, 30-37, 40-41, 43-76, 78-103, 106, 108-113, 116-121, 124-125, 128-147, 150-152, 154-155, 161-162, 164-172, 174, 177-183, 185-191, 193-197, 200-204, 208-213, and 215-234, from the subset thereof comprising SEQ ID NOs: 1-12, 14, 16-26, 30-37, 40-41, 43-58, 60-62, 64-70, 72-75, 78-83, 85-86, 88-91, 93-103, 106, 108-113, 116-119, 121, 124-125, 128-130, 132-147, 150-152, 154-155, 161-162, 164-172, 174, 177-183, 185-191, 193-197, 200-204, 209-213, 215-218, 220-221, 223-231, and 233-234, or the conservative variants thereof, as discussed above.

Techniques which can be employed in accordance with the present invention to alter gene expression, include, but are not limited to: (i) over-expressing a gene product, (ii) disrupting a gene's transcript, such as disrupting a gene's mRNA transcript; (iii) disrupting the function of a polypeptide encoded by a gene, or (iv) disrupting the gene itself. Over-expression of a gene product, the use of antisense RNAs, ribozymes, and the use of double-stranded RNA interference (dsRNAi) are valuable techniques for discovering the functional effects of a gene and for generating plants with a phenotype that is different from a wild-type plant of the same species.

Over-expression of a target gene often is accomplished by cloning the gene or cDNA into an expression vector and introducing the vector into recipient cells. Alternatively, over-expression can be accomplished by introducing exogenous promoters into cells to drive expression of genes residing in the genome. The effect of over-expression of a given gene on cell function, biochemical and/or physiological properties can then be evaluated by comparing plants transformed to over-express the gene to plants that have not been transformed to over-express the gene.

Antisense RNA, ribozyme, and dsRNAi technologies typically target RNA transcripts of genes, usually mRNA. Antisense RNA technology involves expressing in, or introducing into, a cell an RNA molecule (or RNA derivative) that is complementary to, or antisense to, sequences found in a particular mRNA in a cell. By associating with the mRNA, the antisense RNA can inhibit translation of the encoded gene product. The use of antisense technology to reduce or inhibit the expression of specific plant genes has been described, for example in European Patent Publication No. 271988, Smith et al., *Nature*, 334:724-726 (1988); Smith et. al., *Plant Mol. Biol.*, 14:369-379 (1990)).

A ribozyme is an RNA that has both a catalytic domain and a sequence that is complementary to a particular mRNA. The ribozyme functions by associating with the mRNA (through the complementary domain of the ribozyme) and then cleaving (degrading) the message using the catalytic domain.

RNA interference (RNAi) involves a post-transcriptional gene silencing (PTGS) regulatory process:, in which the steady-state level of a specific mRNA is reduced by sequence-specific degradation of the transcribed, usually fully processed mRNA without an alteration in the rate of de novo transcription of the target gene itself. The RNAi technique is discussed, for example, in Elibashir, et al., *Methods Enzymol*. 26: 199 (2002); McManus & Sharp, *Nature Rev. Genetics* 3: 737 (2002); PCT application WO 01/75164; Martinez et al., *Cell* 110: 563 (2002); Elbashir et al., supra; Lagos-Quintana et al., *Curr. Biol.* 12: 735 (2002); Tuschl et al., *Nat. Biotechnol.* 20:446 (2002); Tuschl, *Chembiochem.* 2: 239 (2001); Harborth et al., *J. Cell Sci.* 114: 4557 (2001); et al, *EMBO J.* 20:6877 (2001); Lagos-Quintana et al., *Science*. 294: 8538 (2001); Hutvagner et al., *loc cit,* 834; Elbashir et al., *Nature*. 411: 494 (2001).

The present invention provides a DNA construct comprising at least one polynucleotide of SEQ ID NOs: 1-260 or conservative variants thereof, such as the conservative variants discussed above. Any method known in the art can be used to generate the DNA constructs of the present invention. See, e.g. Sambrook et al., supra.

The invention includes DNA constructs that optionally comprise a promoter. Any suitable promoter known in the art can be used. A promoter is a nucleic acid, preferably DNA, that binds RNA polymerase and/or other transcription regulatory elements. As with any promoter, the promoters of the invention facilitate or control the transcription of DNA or RNA to generate an mRNA molecule from a nucleic acid molecule that is operably linked to the promoter. The RNA can encode a protein or polypeptide or can encode an antisense RNA molecule or a molecule useful in RNAi. Promoters useful in the invention include constitutive promoters, inducible promoters, temporally regulated promoters and tissue-preferred promoters.

Examples of useful constitutive plant promoters include: the cauliflower mosaic virus (CaMV) 35S promoter, which confers constitutive, high-level expression in most plant tissues (Odel et al. *Nature* 313:810(1985)); the nopaline synthase promoter (An et al. *Plant Physiol*. 88:547 (1988)); and the octopine synthase promoter (Fromm et al., *Plant Cell* 1: 977 (1989)). It should be noted that, although the CaMV 35S promoter is commonly referred to as a constitutive promoter, some tissue preference can be seen. The use of CaMV 35S is envisioned by the present invention, regardless of any tissue preference which may be exhibited during use in the present invention.

Inducible promoters regulate gene expression in response to environmental, hormonal, or chemical signals. Examples of hormone inducible promoters include auxin-inducible promoters (Baumann et al. *Plant Cell* 11:323-334(1999)), cytokinin-inducible promoters (Guevara-Garcia, *Plant Mol. Biol.* 38:743-753(1998)), and gibberellin-responsive promoters (Shi et al. *Plant Mol. Biol.* 38:1053-1060(1998)). Additionally, promoters responsive to heat, light, wounding, pathogen resistance, and chemicals such as methyl jasmonate or salicylic acid, can be used in the DNA constructs and methods of the present invention.

Tissue-preferred promoters allow for preferred expression of polynucleotides of the invention in certain plant tissue. Tissue-preferred promoters are also useful for directing the expression of antisense RNA or siRNA in certain plant tissues, which can be useful for inhibiting or completely blocking the expression of targeted genes as discussed above. As used herein, vascular plant tissue refers to xylem, phloem or vascular cambium tissue. Other preferred tissue includes apical meristem, root, seed, and flower. In one aspect, the tissue-preferred promoters of the invention are either "xylem-preferred," "cambium-preferred" or "phloem-preferred," and preferentially direct expression of an operably linked nucleic acid sequence in the xylem, cambium or phloem, respectively. In another aspect, the DNA constructs of the invention comprise promoters that are tissue-specific for xylem, cambium or phloem, wherein the promoters are only active in the xylem, cambium or phloem.

A vascular-preferred promoter is preferentially active in any of the xylem, phloem or cambium tissues, or in at least two of the three tissue types. A vascular-specific promoter is specifically active in any of the xylem, phloem or cambium, or in at least two of the three. In other words, the promoters are only active in the xylem, cambium or phloem tissue of plants. Note, however, that because of solute transport in plants, a product that is specifically or preferentially expressed in a tissue may be found elsewhere in the plant after expression has occurred.

In another embodiment, the promoter is under temporal regulation, wherein the ability of the promoter to initiate expression is linked to factors such as the stage of the cell cycle or the stage of plant development. For example, the promoter of a cyclin D2 gene may be expressed only during the G1 and early S-phase, and the promoters of particular cyclin genes may be expressed only within the primary vascular poles of the developing seedling.

Additionally, the promoters of particular cell cycle genes may be expressed only within the cambium in developing secondary vasculature. Within the cambium, particular cell cycle gene promoters may be expressed exclusively in the stem or in the root. Moreover, the cell cycle promoters may be expressed only in the spring (for early wood formation) or only in the summer.

A promoter may be operably linked to the polynucleotide. As used in this context, operably linked refers to linking a polynucleotide encoding a structural gene to a promoter such that the promoter controls transcription of the structural gene. If the desired polynucleotide comprises a sequence encoding a protein product, the coding region can be operably linked to regulatory elements, such as to a promoter and a terminator, that bring about expression of an associated messenger RNA transcript and/or a protein product encoded by the desired polynucleotide. In this instance, the polynucleotide is operably linked in the 5'- to 3'-orientation to a promoter and, optionally, a terminator sequence.

Alternatively, the invention provides DNA constructs comprising a polynucleotide in an "antisense" orientation, the transcription of which produces nucleic acids that can form secondary structures that affect expression of an endogenous cell cycle gene in the plant cell. In another variation, the DNA construct may comprise a polynucleotide that yields a double-stranded RNA product upon transcription that initiates RNA interference of a cell cycle gene with which the polynucleotide is associated. A polynucleotide of the present invention can be positioned within a t-DNA, such that the left and right t-DNA border sequences flank or are on either side of the polynucleotide.

It should be understood that the invention includes DNA constructs comprising one or more of any of the polynucleotides discussed above. Thus, for example, a construct may comprise a t-DNA comprising one, two, three, four, five, six, seven, eight, nine, ten, or more polynucleotides.

The invention also includes DNA constructs comprising a promoter that includes one or more regulatory elements. Alternatively, the invention includes DNA constructs comprising a regulatory element that is separate from a promoter. Regulatory elements confer a number of important characteristics upon a promoter region. Some elements bind transcription factors that enhance the rate of transcription of the operably linked nucleic acid. Other elements bind repressors that inhibit transcription activity. The effect of transcription factors on promoter activity can determine whether the promoter activity is high or low, i.e. whether the promoter is "strong" or "weak."

A DNA construct of the invention can include a nucleotide sequence that serves as a selectable marker useful in identifying and selecting transformed plant cells or plants. Examples of such markers include, but are not limited to, a neomycin phosphotransferase (nptII) gene (Potrykus et al., *Mol. Gen. Genet.* 199:183-188 (1985)), which confers kanamycin resistance. Cells expressing the nptII gene can be selected using an appropriate antibiotic such as kanamycin or G418. Other commonly used selectable markers include a mutant EPSP synthase gene (Hinchee et al., *Bio/Technology* 6:915-922 (1988)), which confers glyphosate resistance; and a mutant acetolactate synthase gene (ALS), which confers imidazolinone or sulphonylurea resistance (European Patent Application 154,204, 1985).

The present invention also includes vectors comprising the DNA constructs discussed above. The vectors can include an origin of replication (replicons) for a particular host cell. Various prokaryotic replicons are known to those skilled in the art, and function to direct autonomous replication and maintenance of a recombinant molecule in a prokaryotic host cell.

In one embodiment, the present invention utilizes a pWVR8 vector as described in U.S. Application No. 60/476, 222, filed Jun. 6, 2003, or pART27 as described in Gleave, *Plant Mol. Biol,* 20:1203-27 (1992).

The invention also provides host cells which are transformed with the DNA constructs of the invention. As used herein, a host cell refers to the cell in which a polynucleotide of the invention is expressed. Accordingly, a host cell can be an individual cell, a cell culture or cells that are part of an organism. The host cell can also be a portion of an embryo, endosperm, sperm or egg cell, or a fertilized egg. In one embodiment, the host cell is a plant cell.

The present invention further provides transgenic plants comprising the DNA constructs of the invention. The invention includes transgenic plants that are angiosperms or gymnosperms. The DNA constructs of the present invention can be used to transform a variety of plants, both monocotyledonous (e.g grasses, corn, grains, oat, wheat and barley), dicotyledonous (e.g., *Arabidopsis*, tobacco, legumes, alfalfa, oaks, *eucalyptus*, maple), and Gymnosperms (e.g., Scots pine; see Aronen, *Finnish Forest Res. Papers*, Vol. 595, 1996), white spruce (Ellis et al., *Biotechnology* 11:84-89, 1993), and larch (Huang et al., *In Vitro Cell* 27:201-207, 1991).

The plants also include turfgrass, wheat, maize, rice, sugar beet, potato, tomato, lettuce, carrot, strawberry, cassava, sweet potato, geranium, soybean, and various types of woody plants. Woody plants include trees such as palm oak, pine, maple, fir, apple, fig, plum and acacia. Woody plants also include rose and grape vines.

In one embodiment, the DNA constructs of the invention are used to transform woody plants, i.e., trees or shrubs whose stems live for a number of years and increase in diameter each year by the addition of woody tissue. The invention includes methods of transforming plants including eucalyptus and pine species of significance in the commercial forestry industry such as plants selected from the group consisting of *Eucalyptus grandis* and its hybrids, and *Pinus taeda*, as well as the transformed plants and wood and wood pulp derived therefrom. Other examples of suitable plants include those selected from the group consisting of *Pinus banksiana, Pinus brutia, Pinus caribaea, Pinus clausa, Pinus contorta, Pinus*

*coulteri, Pinus echinata, Pinus eldarica, Pinus ellioti, Pinusjeffreyi, Pinus lambertiana, Pinus massoniana, Pinus monticola, Pinus nigra, Pinus palustris, Pinus pinaster, Pinus ponderosa, Pinus radiata, Pinus resinosa, Pinus rigida, Pinus serotina, Pinus strobus, Pinus sylvestris, Pinus taeda, Pinus virginiana, Abies amabilis, Abies balsamea, Abies concolor, Abies grandis, Abies lasiocarpa, Abies magnifica, Abies procera, Chamaecyparis lawsoniana, Chamaecyparis nootkatensis, Chamaecyparis thyoides, Juniperus virginiana, Larix decidua, Larix laricina, Larix leptolepis, Larix occidentalis, Larix siberica, Libocedrus decurrens, Picea abies, Picea engelmanni, Picea glauca, Picea mariana, Picea pungens, Picea rubens, Picea sitchensis, Pseudotsuga menziesii, Sequoia gigantea, Sequoia sempervirens, Taxodium distichum, Tsuga canadensis, Tsuga heterophylla, Tsuga mertensiana, Thuja occidentalis, Thuja plicata, Eucalyptus alba, Eucalyptus bancroflii, Eucalyptus botryoides, Eucalyptus bridgesiana, Eucalyptus calophylla, Eucalyptus camaldulensis, Eucalyptus citriodora, Eucalyptus cladocalyx, Eucalyptus coccifera, Eucalyptus curtisii, Eucalyptus dalrympleana, Eucalyptus deglupta, Eucalyptus delagatensis, Eucalyptus diversicolor, Eucalyptus dunnii, Eucalyptus ficifolia, Eucalyptus globulus, Eucalyptus gomphocephala, Eucalyptus gunnii, Eucalyptus henryi, Eucalyptus laevopinea, Eucalyptus macarthurii, Eucalyptus macrorhyncha, Eucalyptus maculata, Eucalyptus marginata, Eucalyptus megacarpa, Eucalyptus melliodora, Eucalyptus nicholii, Eucalyptus nitens, Eucalyptus nova-angelica, Eucalyptus obliqua, Eucalyptus occidentalis, Eucalyptus obtusiflora, Eucalyptus oreades, Eucalyptus pauciflora, Eucalyptus polybractea, Eucalyptus regnans, Eucalyptus resinifera, Eucalyptus robusta, Eucalyptus rudis, Eucalyptus saligna, Eucalyptus sideroxylon, Eucalyptus stuartiana, Eucalyptus tereticornis, Eucalyptus torelliana, Eucalyptus urnigera, Eucalyptus urophylla, Eucalyptus viminalis, Eucalyptus viridis, Eucalyptus wandoo,* and *Eucalyptus youmanni.*

As used herein, the term "plant" also is intended to include the fruit, seeds, flower, strobilus, etc. of the plant. A transformed plant of the current invention can be a direct transfectant, meaning that the DNA construct was introduced directly into the plant, such as through *Agrobacterium*, or the plant can be the progeny of a transfected plant. The second or subsequent generation plant can be produced by sexual reproduction, i.e., fertilization. Furthermore, the plant can be a gametophyte (haploid stage) or a sporophyte (diploid stage).

As used herein, the term "plant tissue" encompasses any portion of a plant, including plant cells. Plant cells include suspension cultures, callus, embryos, meristematic regions, callus tissue, leaves, roots, shoots, gametophytes, sporophytes, pollen, seeds and microspores. Plant tissues can be grown in liquid or solid culture, or in soil or suitable media in pots, greenhouses or fields. As used herein, "plant tissue" also refers to a clone of a plant, seed, progeny, or propagule, whether generated sexually or asexually, and descendents of any of these, such as cuttings or seeds.

In accordance with one aspect of the invention, a transgenic plant that has been transformed with a DNA construct of the invention has a phenotype that is different from a plant that has not been transformed with the DNA construct.

As used herein, "phenotype" refers to a distinguishing feature or characteristic of a plant which can be altered according to the present invention by integrating one or more DNA constructs of the invention into the genome of at least one plant cell of a plant. The DNA construct can confer a change in the phenotype of a transformed plant by modifying any one or more of a number of genetic, molecular, biochemical, physiological, morphological, or agronomic characteristics or properties of the transformed plant cell or plant as a whole.

In one embodiment, transformation of a plant with a DNA construct of the present invention can yield a phenotype including, but not limited to any one or more of increased drought tolerance, herbicide resistance, reduced or increased height, reduced or increased branching, enhanced cold and frost tolerance, improved vigor, enhanced color, enhanced health and nutritional characteristics, improved storage, enhanced yield, enhanced salt tolerance, enhanced resistance of the wood to decay, enhanced resistance to fingal diseases, altered attractiveness to insect pests, enhanced heavy met al tolerance, increased disease tolerance, increased insect tolerance, increased water-stress tolerance, enhanced sweetness, improved texture, decreased phosphate content, increased germination, increased micronutrient uptake, improved starch composition, improved flower longevity, production of novel resins, and production of novel proteins or peptides.

In another embodiment, the affected phenotype includes one or more of the following traits: propensity to form reaction wood, a reduced period of juvenility, an increased period of juvenility, self-abscising branches, accelerated reproductive development or delayed reproductive development, as compared to a plant of the same species that has not been transformed with the DNA construct.

In a further embodiment, the phenotype that is different in the transgenic plant includes one or more of the following: lignin quality, lignin structure, wood composition, wood appearance, wood density, wood strength, wood stiffness, cellulose polymerization, fiber dimensions, lumen size, other plant components, plant cell division, plant cell development, number of cells per unit area, cell size, cell shape, cell wall composition, rate of wood formation, aesthetic appearance of wood, formation of stem defects, average microfibril angle, width of the S2 cell wall layer, rate of growth, rate of root formation ratio of root to branch vegetative development, leaf area index, and leaf shape.

Phenotype can be assessed by any suitable means. The plants can be evaluated based on their general morphology. Transgenic plants can be observed with the naked eye, can be weighed and their height measured. The plant can be examined by isolating individual layers of plant tissue, namely phloem and cambium, which is further sectioned into meristematic cells, early expansion, late expansion, secondary wall formation, and late cell maturation. See, e.g., Hertzberg, supra. The plants also can be assessed using microscopic analysis or chemical analysis.

Microscopic analysis includes examining cell types, stage of development, and stain uptake by tissues and cells. Fiber morphology, such as fiber wall thickness and microfibril angle of wood pulp fibers can be observed using, for example, microscopic transmission ellipsometry. See Ye and Sundström, *Tappi J.,* 80:181 (1997). Wood strength, density, and grain slope in wet wood and standing trees can be determined by measuring the visible and near infrared spectral data in conjunction with multivariate analysis. See, U.S. Patent Application Publication Nos. 2002/0107644 and 2002/0113212. Lumen size can be measured using scanning electron microscopy. Lignin structure and chemical properties can be observed using nuclear magnetic resonance spectroscopy as described in Marita et al., *J. Chem. Soc., Perkin Trans. I* 2939 (2001).

The biochemical characteristic of lignin, cellulose, carbohydrates and other plant extracts can be evaluated by any standard analytical method known including spectrophotometry, fluorescence spectroscopy, HPLC, mass spectroscopy, and tissue staining methods.

As used herein, "transformation" refers to a process by which a nucleic acid is inserted into the genome of a plant cell. Such insertion encompasses stable introduction into the plant cell and transmission to progeny. Transformation also refers to transient insertion of a nucleic acid, wherein the resulting transformant transiently expresses the nucleic acid. Transformation can occur under natural or artificial conditions using various methods well known in the art. Transformation can be achieved by any known method for the insertion of nucleic acid sequences into a prokaryotic or eukaryotic host cell, including *Agrobacterium*-mediated transformation protocols, viral infection, whiskers, electroporation, microinjection, polyethylene glycol-treatment, heat shock, lipofection, and particle bombardment. Transformation can also be accomplished using chloroplast transformation as described in e.g. Svab et al., *Proc. Natl Acad. Sci.* 87:8526-30 (1990).

In accordance with one embodiment of the invention, transformation in *Eucalyptus* is performed as described in U.S. Patent Application No. 60/476,222 (supra) which is incorporated herein by reference in its entirety. In accordance with another embodiment, transformation of *Pinus* is accomplished using the methods described in U.S. Patent Application Publication No. 2002/0100083.

Another aspect of the invention provides methods of obtaining wood and/or making wood pulp from a plant transformed with a DNA construct of the invention. Methods of producing a transgenic plant are provided above and are known in the art. A transformed plant can be cultured or grown under any suitable conditions. For example, pine can be cultured and grown as described in U.S. Patent Application Publication No. 2002/0100083. *Eucalyptus* can be cultured and grown as in, for example, Rydelius, et al., GROWING EUCALYPTUS FOR PULP AND ENERGY, presented at the Mechanization in Short Rotation, Intensive Culture Forestry Conference, Mobile, Ala., 1994. Wood and wood pulp can be obtained from the plant by any means known in the art.

As noted above, the wood or wood pulp obtained in accordance with this invention may demonstrate improved characteristics including, but not limited to any one or more of lignin composition, lignin structure, wood composition, cellulose polymerization, fiber dimensions, ratio of fibers to other plant components, plant cell division, plant cell development, number of cells per unit area, cell size, cell shape, cell wall composition, rate of wood formation, aesthetic appearance of wood, formation of stem defects, rate of growth, rate of root formation ratio of root to branch vegetative development, leaf area index, and leaf shape include increased or decreased lignin content, increased accessibility of lignin to chemical treatments, improved reactivity of lignin, increased or decreased cellulose content increased dimensional stability, increased tensile strength, increased shear strength, increased compression strength, increased shock resistance, increased stiffness, increased or decreased hardness, decreased spirality, decreased shrinkage, and differences in weight, density, and specific gravity.

B. Expression Profiling of Cell Cycle Genes

The present invention also provides methods and tools for performing expression profiling of cell cycle genes. Expression profiling is useful in determining whether genes are transcribed or translated, comparing transcript levels for particular genes in different tissues, genotyping, estimating DNA copy number, determining identity of descent, measuring mRNA decay rates, identifying protein binding sites, determining subcellular localization of gene products, correlating gene expression to a phenotype or other phenomenon, and determining the effect on other genes of the manipulation of a particular gene. Expression profiling is particularly useful for identifying gene expression in complex, multigenic events. For this reason, expression profiling is useful in correlating gene expression to plant phenotype and formation of plant tissues and the interconnection thereof to the cell cycle.

Only a small fraction of the genes of a plant's genome are expressed at a given time in a given tissue sample, and all of the expressed genes may not affect the plant phenotype. To identify genes capable of affecting a phenotype of interest, the present invention provides methods and tools for determining, for example, a gene expression profile at a given point in the cell cycle, a gene expression profile at a given point in plant development, and a gene expression profile a given tissue sample. The invention also provides methods and tools for identifying cell cycle genes whose expression can be manipulated to alter plant phenotype or to alter the biological activity of cell cycle gene products. In support of these methods, the invention also provides methods and tools that distinguish expression of different genes of the same family.

As used herein, "gene expression" refers to the process of transcription of a DNA sequence into an RNA sequence, followed by translation of the RNA into a protein, which may or may not undergo post-translational processing. Thus, the relationship between cell cycle stage and/or developmental stage and gene expression can be observed by detecting, quantitatively or qualitatively, changes in the level of an RNA or a protein. As used herein, the term "biological activity" includes, but is not limited to, the activity of a protein gene product, including enzyme activity.

The present invention provides oligonucleotides that are useful in these expression profiling methods. Each oligonucleotide is capable of hybridizing under a given set of conditions to a cell cycle gene or gene product. In one aspect of the invention, a plurality of oligonucleotides is provided, wherein each oligonucleotide hybridizes under a given set of conditions to a different cell cycle gene product. Examples of oligonucleotides of the present invention include SEQ ID NOs: 521-772. Each of the oligos of SEQ ID NOs 521-772 hybridizes under standard conditions to a different gene product of one of SEQ ID NOs: 1-260. The oligonucleotides of the invention are useful in determining the expression of one or more cell cycle genes in any of the above-described methods.

1. Cell, Tissue, Nucleic Acid, and Protein Samples

Samples for use in methods of the present invention may be derived from plant tissue. Suitable plant tissues include, but are not limited to, somatic embryos, pollen, leaves, stems, calli, stolons, microtubers, shoots, xylem, male strolbili, pollen cones, vascular tissue, apical meristem, vascular cambium, xylem, root, flower, and seed.

According to the present invention "plant tissue" is used as described previously herein. Plant tissue can be obtained from any of the plants types or species described supra.

In accordance with one aspect of the invention, samples are obtained from plant tissue at different stages of the cell cycle, from plant tissue at different developmental stages, from plant tissue at various times of the year (e.g. spring versus summer), from plant tissues subject to different environmental conditions (e.g. variations in light and temperature) and/or from different types of plant tissue and cells. In accordance with one embodiment, plant tissue is obtained during various stages of maturity and during different seasons of the year. For example, plant tissue can be collected from stem dividing cells, differentiating xylem, early developing wood cells, differentiated spring wood cells, and differentiated summer wood cells. As another example, gene expression in a sample obtained from a plant with developing wood can be compared to gene expression in a sample obtained from a plant which does not have developing wood.

Differentiating xylem includes samples obtained from compression wood, side-wood, and normal vertical xylem. Methods of obtaining samples for expression profiling from pine and *eucalyptus* are known. See, e.g., Allona et al., *Proc. Nat'l Acad. Sci.* 95:9693-8 (1998) and Whetton et al., *Plant Mol. Biol.* 47:275-91, and Kirst et al., INT'L UNION OF FORESTRY RESEARCH ORGANIZATIONS BIENNIAL CONFERENCE, S6.8 (June 2003, Umea, Sweden).

In one embodiment of the invention, gene expression in one type of tissue is compared to gene expression in, a different type of tissue or to gene expression in the same type of tissue in a difference stage of development. Gene expression can also be compared in one type of tissue which is sampled at various times during the year (different seasons). For example, gene expression in juvenile secondary xylem can be compared to gene expression in mature secondary xylem. Similarly, gene expression in cambium can be compared to gene expression in xylem. Furthermore, gene expression in apical meristems can be compared to gene expression in cambium.

In an alternative embodiment, differences in gene expression are determined as cells from different tissues advance during the cell cycle. In this method, the cells from the different tissues are synchronized and their gene expression is profiled. Methods of synchronizing the stage of cell cycle in a sample are known. These methods include, e.g., cold acclimation, photoperiod, and aphidicoline. See, e.g., Nagata et al., *Int. Rev. Cytol.* 132:1-30 (1992), Breyne and Zabeau, *Curr. Opin. Plant Biol.* 4:136-42, 140 (2001). A sample is obtained during a specific stage of the cell cycle and gene expression in that sample is compared to a sample obtained during a different stage of the cell cycle. For example, tissue can be examined in any of the phases of the cell cycle, such as mitosis, G1, G1, S, and G2. In particular, one can examine the changes in gene expression at the G1, G2, and metaphase checkpoints.

In another embodiment of the invention, a sample is obtained from a plant having a specific phenotype and gene expression in that sample is compared to a sample obtained from a plant of the same species that does not have that phenotype. For example, a sample can be obtained from a plant exhibiting a fast rate of growth and gene expression can be compared with that of a sample obtained from a plant exhibiting a normal or slow rate of growth. Differentially expressed genes identified from such a comparison can be correlated with growth rate and, therefore, useful for manipulating growth rate.

In a further embodiment, a sample is obtained from clonally propagated plants. In one embodiment the clonally propagated plants are of the species *Pinus* or *Eucalyptus*. Individual ramets from the same genotype can be sacrificed at different times of year. Thus, for any genotype there can be at least two genetically identical trees sacrificed, early in the season and late in the season. Each of these trees can be divided into juvenile (top) to mature (bottom) samples. Further, tissue samples can be divided into, for example, phloem to xylem, in at least 5 layers of peeling. Each of these samples can be evaluated for phenotype and gene expression. See Entry 196.

Where cellular components may interfere with an analytical technique, such as a hybridization assay, enzyme assay, a ligand binding assay, or a biological activity assay, it may be desirable to isolate the gene products from such cellular components. Gene products, including nucleic acid and amino acid gene products, can be isolated from cell fragments or lysates by any method known in the art.

Nucleic acids used in accordance with the invention can be prepared by any available method or process, or by other processes as they become known in the art. Conventional techniques for isolating nucleic acids are detailed, for example, in Tijssen, LABORATORY TECHNIQUES IN BIOCHEMISTRY AND MOLECULAR BIOLOGY: HYBRIDIZATION WITH NUCLEIC ACID PROBES, chapter 3 (Elsevier Press, 1993), Berger and Kimmel, *Methods Enzymol.* 152:1 (1987), and GIBCO BRL & LIFE TECHNOLOGIES TRIZOL RNA ISOLATION PROTOCOL, Form No. 3786 (2000). Techniques for preparing nucleic acid samples, and sequencing polynucleotides from pine and eucalyptus are known. See, e.g., Allona et al., supra and Whetton et al., supra, and U.S. Application No. 60/476,222.

A suitable nucleic acid sample can contain any type of nucleic acid derived from the transcript of a cell cycle gene, i.e., RNA or a subsequence thereof or a nucleic acid for which an mRNA transcribed from a cell cycle gene served as a template. Suitable nucleic acids include cDNA reverse-transcribed from a transcript, RNA transcribed from that cDNA, DNA amplified from the cDNA, and RNA transcribed from the amplified DNA. Detection of such products or derived products is indicative of the presence and/or abundance of the transcript in the sample. Thus, suitable samples include, but are not limited to, transcripts of the gene or genes, cDNA reverse-transcribed from the transcript, cRNA transcribed from the cDNA, DNA amplified from the genes, and RNA transcribed from amplified DNA. As used herein, the category of "transcripts" includes but is not limited to pre-mRNA nascent transcripts, transcript processing intermediates, and mature mRNAs and degradation products thereof.

It is not necessary to monitor all types of transcripts to practice the invention. For example, the expression profiling methods of the invention can be conducted by detecting only one type of transcript, such as mature mRNA levels only.

In one aspect of the invention, a chromosomal DNA or cDNA library (comprising, for example, fluorescently labeled cDNA synthesized from total cell mRNA) is prepared for use in hybridization methods according to recognized methods in the art. See Sambrook et al., supra.

In another aspect of the invention, mRNA is amplified using, e.g., the MessageAmp kit (Ambion). In a further aspect, the mRNA is labeled with a detectable label. For example, mRNA can be labeled with a fluorescent chromophore, such as CyDye (Amersham Biosciences).

In some applications, it may be desirable to inhibit or destroy RNase that often is present in homogenates or lysates, before use in hybridization techniques. Methods of inhibiting or destroying nucleases are well known. In one embodiment of the invention, cells or tissues are homogenized in the presence of chaotropic agents to inhibit nuclease. In another embodiment, RNase is inhibited or destroyed by heat treatment, followed by proteinase treatment.

Protein samples can be obtained by any means known in the art. Protein samples useful in the methods of the invention include crude cell lysates and crude tissue homogenates. Alternatively, protein samples can be purified. Various methods of protein purification well known in the art can be found in Marshak et al., STRATEGIES FOR PROTEIN PURIFICATION AND CHARACTERIZATION: A LABORATORY COURSE MANUAL (Cold Spring Harbor Laboratory Press 1996).

2. Detecting Level of Gene Expression

For methods of the invention that comprise detecting a level of gene expression, any method for observing gene expression can be used, without limitation. Such methods include traditional nucleic acid hybridization techniques, polymerase chain reaction (PCR) based methods, and protein determination. The invention includes detection methods that use solid support-based assay formats as well as those that use solution-based assay formats.

Absolute measurements of the expression levels need not be made, although they can be made. The invention includes methods comprising comparisons of differences in expression levels between samples. Comparison of expression levels can be done visually or manually, or can be automated and done by a machine, using for example optical detection means. Subrahmanyam et al., *Blood*. 97: 2457 (2001); Prashar et al., *Methods Enzymol*. 303: 258 (1999). Hardware and software for analyzing differential expression of genes are available, and can be used in practicing the present invention. See, e.g., GenStat Software and GeneExpress® GX Explorer™ Training Manual, supra; Baxevanis & Francis-Ouellette, supra.

In accordance with one embodiment of the invention, nucleic acid hybridization techniques are used to observe gene expression. Exemplary hybridization techniques include Northern blotting, Southern blotting, solution hybridization, and S1 nuclease protection assays.

Nucleic acid hybridization typically involves contacting an oligonucleotide probe and a sample comprising nucleic acids under conditions where the probe can form stable hybrid duplexes with its complementary nucleic acid through complementary base pairing. For example, see PCT application WO 99/32660; Berger & Kimmel, *Methods Enzymol*. 152: 1 (1987). The nucleic acids that do not form hybrid duplexes are then washed away leaving the hybridized nucleic acids to be detected, typically through detection of an attached detectable label. The detectable label can be present on the probe, or on the nucleic acid sample. In one embodiment, the nucleic acids of the sample are detectably labeled polynucleotides representing the mRNA transcripts present in a plant tissue (e.g., a cDNA library). Detectable labels are commonly radioactive or fluorescent labels, but any label capable of detection can be used. Labels can be incorporated by several approached described, for instance, in WO 99/32660, supra. In one aspect RNA can be amplified using the MessageAmp kit (Ambion) with the addition of aminoallyl-UTP as well as free UTP. The aminoallyl groups incorporated into the amplified RNA can be reacted with a fluorescent chromophore, such as CyDye (Amersham Biosciences)

Duplexes of nucleic acids are destabilized by increasing the temperature or decreasing the salt concentration of the buffer containing the nucleic acids. Under low stringency conditions (e.g., low temperature and/or high salt) hybrid duplexes (e.g., DNA:DNA, RNA:RNA or RNA:DNA) will form even where the annealed sequences are not perfectly complementary. Thus, specificity of hybridization is reduced at lower stringency. Conversely, at higher stringency (e.g., higher temperature and/or lower salt and/or in the presence of destabilizing reagents) hybridization tolerates fewer mismatches.

Typically, stringent conditions for short probes (e.g., 10 to 50 nucleotide bases) will be those in which the salt concentration is at least about 0.01 to 1.0 M at pH 7.0 to 8.3 and the temperature is at least about 30° C. Stringent conditions can also be achieved with the addition of destabilizing agents such as formamide.

Under some circumstances, it can be desirable to perform hybridization at conditions of low stringency, e.g., 6×SSPE-T (0.9 M NaCl, 60 mM $NaH_2PO_4$, pH 7.6, 6 mM EDTA, 0.005% Triton) at 37° C, to ensure hybridization. Subsequent washes can then be performed at higher stringency (e.g., 1×SSPE-T at 37° C.) to eliminate mismatched hybrid duplexes. Successive washes can be performed at increasingly higher stringency (e.g., down to as low as 0.25×SSPE-T at 37° C. to 50° C.) until a desired level of hybridization specificity is obtained.

In general, standard conditions for hybridization is a compromise between stringency (hybridization specificity) and signal intensity. Thus, in one embodiment of the invention, the hybridized nucleic acids are washed at successively higher stringency conditions and read between each wash. Analysis of the data sets produced in this manner will reveal a wash stringency above which the hybridization pattern is not appreciably altered and which provides adequate signal for the particular oligonucleotide probes of interest. For example, the final wash may be selected as that of the highest stringency that produces consistent results and that provides a signal intensity greater than approximately 10% of the background intensity.

a. Oligonucleotide Probes

Oligonucleotide probes useful in nucleic acid hybridization techniques employed in the present invention are capable of binding to a nucleic acid of complementary sequence through one or more types of chemical bonds, usually through complementary base pairing via hydrogen bond formation. A probe can include natural bases (i.e., A, G, U, C or T) or modified bases (7-deazaguanosine, inosine, etc.). In addition, the nucleotide bases in the probes can be joined by a linkage other than a phosphodiester bond, so long as it does not interfere with hybridization. Thus, probes can be peptide nucleic acids in which the constituent bases are joined by peptide bonds rather than phosphodiester linkages.

Oligonucleotide probes can be prepared by any means known in the art. Probes useful in the present invention are capable of hybridizing to a nucleotide product of cell cycle genes, such as one of SEQ ID NOs: 1-260. Probes useful in the invention can be generated using the nucleotide sequences disclosed in SEQ ID NOs: 1-260. The invention includes oligonucleotide probes having at least a 2, 10,15, 20, 30, 35, 40, 45, 50, 55, 60, 65, 70, 75, 80, 85, or 100 nucleotide fragment of a corresponding contiguous sequence of any one of SEQ liD NOs: 1-260. The invention includes oligonucleotides of less than 2, 1, 0.5, 0.1, or 0.05 kb in length. In one embodiment, the oligonucleotide is 60 nucleotides in length.

Oligonucleotide probes can be designed by any means known in the art. See, e.g., Li and Stormo, Bioinformatics 17: 1067-76 (2001). Oligonucleotide probe design can be effected using software. Exemplary software includes Array-Designer, GeneScan, and ProbeSelect. Probes complementary to a defined nucleic acid sequence can be synthesized chemically, generated from longer nucleotides using restriction enzymes, or can be obtained using techniques such as polymerase chain reaction (PCR). PCR methods are well known and are described, for example, in Innis et al. eds., PCR PROTOCOLS: A GUIDE TO METHODS AND APPLICATIONS, Academic Press Inc. San Diego, Calif. (1990). The probes can be labeled, for example, with a radioactive, biotinylated, or fluorescent tag. Optimally, the nucleic acids in the sample are labeled and the probes are not labeled. Oligonucleotide probes generated by the above methods can be used in solution or solid support-based methods.

The invention includes oligonucleotide probes that hybridize to a product of the coding region or a 3' untranslated region (3' UTR) of a cell cycle gene. In one embodiment, the oligonucleotide probe hybridizes to the 3' UTR of any one of SEQ ID NOs: 1-260. The 3' UTR is generally a unique region of the gene, even among members of the same family. Therefore, the probes capable of hybridizing to a product of the 3' UTR can be useful for differentiating the expression of individual genes within a family where the coding region of the genes likely are highly homologous. This allows for the design of oligonucleotide probes to be used as members of a plurality of oligonucleotides, each capable of uniquely binding to a single gene. In another embodiment, the oligonucleotide probe comprises any one of SEQ ID NOs: 521-772. In another embodiment, the oligonucleotide probe consists of any one of SEQ ID NOs: 521-772.

b. Oligonucleotide Array Methods

One embodiment of the invention employs two or more oligonucleotide probes in combination to detect a level of expression of one or more cell cycle genes, such as the genes of SEQ ID NOs: 1-260. In one aspect of this embodiment, the level of expression of two or more different genes is detected. The two or more genes may be from the same or different cell cycle gene families discussed above. Each of the two or more oligonucleotides may hybridize to a different one of the genes.

One embodiment of the invention employs two or more oligonucleotide probes, each of which specifically hybridize to a polynucleotide derived from the transcript of a gene provided by SEQ ID NOs: 1-260. Another embodiment employs two or more oligonucleotide probes, at least one of which comprises a nucleic acid sequence of SEQ ID NOs: 521-772. Another embodiment employs two or more oligonucleotide probes, at least one of which consists of SEQ ID NOs: 521-772.

The oligonucleotide probes may comprise from about 5 to about 60, or from about 5 to about 500, nucleotide bases, such as from about 60 to about 100 nucleotide bases, including from about 15 to about 60 nucleotide bases.

One embodiment of the invention uses solid support-based oligonucleotide hybridization methods to detect gene expression. Solid support-based methods suitable for practicing the present invention are widely known and are described, for example, in PCT application WO 95/11755; Huber et al., *Anal. Biochem.* 299: 24 (2001); Meiyanto et al., *Biotechniques.* 31: 406 (2001); Relogio et al., *Nucleic Acids Res.* 30:e51 (2002). Any solid surface to which oligonucleotides can be bound, covalently or non-covalently, can be used. Such solid supports include filters, polyvinyl chloride dishes, silicon or glass based chips, etc.

One embodiment uses oligonucleotide arrays, i.e. microarrays, which can be used to simultaneously observe the expression of a number of genes or gene products. Oligonucleotide arrays comprise two or more oligonucleotide probes provided on a solid support, wherein each probe occupies a unique location on the support. The location of each probe may be predetermined, such that detection of a detectable signal at a given location is indicative of hybridization to an oligonucleotide probe of a known identity. Each predetermined location can contain more than one molecule of a probe, but each molecule within the predetermined location has an identical sequence. Such predetermined locations are termed features. There can be, for example, from 2, 10, 100, 1,000, 2,000 or 5,000 or more of such features on a single solid support. In one embodiment, each oligonucleotide is located at a unique position on an array at least 2, at least 3, at least 4, at least 5, at least 6, or at least 10 times.

Oligonucleotide probe arrays for detecting gene expression can be made and used according to conventional techniques described, for example, in Lockhart et al., *Nat'l Biotech.* 14: 1675 (1996), McGall et al., *Proc. Nat'l Acad Sci. USA* 93: 13555 (1996), and Hughes et al., *Nature Biotechnol.* 19:342 (2001). A variety of oligonucleotide array designs is suitable for the practice of this invention.

In one embodiment the one or more oligonucleotides include a plurality of oligonucleotides that each hybridize to a different gene expressed in a particular tissue type. For example, the tissue can be developing wood.

In one embodiment, a nucleic acid sample obtained from a plant can be amplified and, optionally labeled with a detectable label. Any method of nucleic acid amplification and any detectable label suitable for such purpose can be used. For example, amplification reactions can be performed using, e.g. Ambion's MessageAmp, which creates "antisense" RNA or "aRNA" (complementary in nucleic acid sequence to the RNA extracted from the sample tissue). The RNA can optionally be labeled using CyDye fluorescent labels. During the amplification step, aaUTP is incorporated into the resulting aRNA. The CyDye fluorescent labels are coupled to the aaUTPs in a non-enzymatic reaction. Subsequent to the amplification and labeling steps, labeled amplified antisense RNAs are precipitated and washed with appropriate buffer, and then assayed for purity. For example, purity can be assay using a NanoDrop spectrophotometer. The nucleic acid sample is then contacted with an oligonucleotide array having, attached to a solid substrate (a "microarray slide"), oligonucleotide sample probes capable of hybridizing to nucleic acids of interest which may be present in the sample. The step of contacting is performed under conditions where hybridization can occur between the nucleic acids of interest and the oligonucleotide probes present on the array. The array is then washed to remove non-specifically bound nucleic acids and the signals from the labeled molecules that remain hybridized to oligonucleotide probes on the solid substrate are detected. The step of detection can be accomplished using any method appropriate to the type of label used. For example, the step of detecting can accomplished using a laser scanner and detector. For example, on can use and Axon scanner which optionally uses GenePix Pro software to analyze the position of the signal on the microarray slide.

Data from one or more microarray slides can analyzed by any appropriate method known in the art.

Oligonucleotide probes used in the methods of the present invention, including microarray techniques, can be generated using PCR. PCR primers used in generating the probes are chosen, for example, based on the sequences of SEQ ID NOs: 1-260, to result in amplification of unique fragments of the cell cycle genes (i.e., fragments that hybridize to only one polynucleotide of any one of SEQ ID NOs: 1-260 under standard hybridization conditions). Computer programs are useful in the design of primers with the required specificity and optimal hybridization properties. For example, Li and Stormo, supra at 1075, discuss a method of probe selection using ProbeSelect which selects an optimum oligonucleotide probe based on the entire gene sequence as well as other gene sequences to be probed at the same time.

In one embodiment, oligonucleotide control probes also are used. Exemplary control probes can fall into at least one of three categories referred to herein as (1) normalization controls, (2) expression level controls and (3) negative controls. In microarray methods, one or more of these control probes may be provided on the array with the inventive cell cycle gene-related oligonucleotides.

Normalization controls correct for dye biases, tissue biases, dust, slide irregularities, malformed slide spots, etc. Normalization controls are oligonucleotide or other nucleic acid probes that are complementary to labeled reference oligonucleotides or other nucleic acid sequences that are added to the nucleic acid sample to be screened. The signals obtained from the normalization controls, after hybridization, provide a control for variations in hybridization conditions, label intensity, reading efficiency and other factors that can cause the signal of a perfect hybridization to vary between arrays. In one embodiment, signals (e.g., fluorescence intensity or radioactivity) read from all other probes used in the method are divided by the signal from the control probes, thereby normalizing the measurements.

Virtually any probe can serve as a normalization control. Hybridization efficiency varies, however, with base composition and probe length. Preferred normalization probes are selected to reflect the average length of the other probes being used, but they also can be selected to cover a range of lengths. Further, the normalization control(s) can be selected to reflect the average base composition of the other probes being used. In one embodiment, only one or a few normalization probes are used, and they are selected such that they hybridize well (i.e., without forming secondary structures) and do not match any test probes. In one embodiment, the normalization controls are mammalian genes.

Expression level controls probes hybridize specifically with constitutively expressed genes present in the biological sample. Virtually any constitutively expressed gene provides a suitable target for expression level control probes. Typically, expression level control probes have sequences complementary to subsequences of constitutively expressed "housekeeping genes" including, but not limited to certain photosynthesis genes.

"Negative control" probes are not complementary to any of the test oligonucleotides (i.e., the inventive cell cycle gene-related oligonucleotides), normalization controls, or expression controls. In one embodiment, the negative control is a mammalian gene which is not complementary to any other sequence in the sample.

The terms "background" and "background signal intensity" refer to hybridization signals resulting from non-specific binding or other interactions between the labeled target nucleic acids (i.e., mRNA present in the biological sample) and components of the oligonucleotide array. Background signals also can be produced by intrinsic fluorescence of the array components themselves.

A single background signal can be calculated for the entire array, or a different background signal can be calculated for each target nucleic acid. In a one embodiment, background is calculated as the average hybridization signal intensity for the lowest 5 to 10 percent of the oligonucleotide probes being used, or, where a different background signal is calculated for each target gene, for the lowest 5 to 10 percent of the probes for each gene. Where the oligonucleotide probes corresponding to a particular cell cycle gene hybridize well and, hence, appear to bind specifically to a target sequence, they should not be used in a background signal calculation. Alternatively, background can be calculated as the average hybridization signal intensity produced by hybridization to probes that are not complementary to any sequence found in the sample (e.g., probes directed to nucleic acids of the opposite sense or to genes not found in the sample). In microarray methods, background can be calculated as the average signal intensity produced by regions of the array that lack any oligonucleotides probes at all.

c. PCR-Based Methods

In another embodiment, PCR-based methods are used to detect gene expression. These methods include reverse-transcriptase-mediated polymerase chain reaction (RT-PCR) including real-time and endpoint quantitative reverse-transcriptase-mediated polymerase chain reaction (Q-RTPCR). These methods are well known in the art. For example, methods of quantitative PCR can be carried out using kits and methods that are commercially available from, for example, Applied BioSystems and Stratagene®. See also Kochanowski, QUANTITATIVE PCR PROTOCOLS (Humana Press, 1999); Innis et al., supra.; Vandesompele et al., *Genome Biol.* 3: RESEARCH0034 (2002); Stein, *Cell Mol. Life Sci.* 59: 1235 (2002).

Gene expression can also be observed in solution using Q-RTPCR. Q-RTPCR relies on detection of a fluorescent signal produced proportionally during amplification of a PCR product. See Innis et al., supra. Like the traditional PCR method, this technique employs PCR oligonucleotide primers, typically 15-30 bases long, that hybridize to opposite strands and regions flanking the DNA region of interest. Additionally, a probe (e.g., TaqMan®, Applied Biosystems) is designed to hybridize to the target sequence between the forward and reverse primers traditionally used in the PCR technique. The probe is labeled at the 5' end with a reporter fluorophore, such as 6-carboxyfluorescein (6-FAM) and a quencher fluorophore like 6-carboxy-tetramethyl-rhodamine (TAMRA). As long as the probe is intact, fluorescent energy transfer occurs which results in the absorbance of the fluorescence emission of the reporter fluorophore by the quenching fluorophore. As Taq polymerase extends the primer, however, the intrinsic 5' to 3' nuclease activity of Taq degrades the probe, releasing the reporter fluorophore. The increase in the fluorescence signal detected during the amplification cycle is proportional to the amount of product generated in each cycle.

The forward and reverse amplification primers and internal hybridization probe is designed to hybridize specifically and uniquely with one nucleotide derived from the transcript of a target gene. In one embodiment, the selection criteria for primer and probe sequences incorporates constraints regarding nucleotide content and size to accommodate TaqMan® requirements.

SYBR Green® can be used as a probe-less Q-RTPCR alternative to the Taqman®-type assay, discussed above. ABI PRISM® 7900 SEQUENCE DETECTION SYSTEM USER GUIDE APPLIED BIOSYSTEMS, chap. 1-8, App. A-F. (2002).

A device measures changes in fluorescence emission intensity during PCR amplification. The measurement is done in "real time," that is, as the amplification product accumulates in the reaction. Other methods can be used to measure changes in fluorescence resulting from probe digestion. For example, fluorescence polarization can distinguish between large and small molecules based on molecular tumbling (see U.S. Pat. No. 5,593,867).

d. Protein Detection Methods

Proteins can be observed by any means known in the art, including immunological methods, enzyme assays and protein array/proteomics techniques.

Measurement of the translational state can be performed according to several protein methods. For example, whole genome monitoring of protein—the "proteome"—can be carried out by constructing a microarray in which binding sites comprise immobilized, preferably monoclonal, antibodies specific to a plurality of proteins having an amino acid sequence of any of SEQ ID NOs: 261-520 or proteins encoded by the genes of SEQ ID NOs: 1-260 or conservative variants thereof. See Wildt et al., *Nature Biotechnol.* 18: 989 (2000). Methods for making polyclonal and monoclonal antibodies are well known, as described, for instance, in Harlow & Lane, ANTIBODIES: A LABORATORY MANUAL (Cold Spring Harbor Laboratory Press, 1988).

Alternatively, proteins can be separated by two-dimensional gel electrophoresis systems. Two-dimensional gel electrophoresis is well-known in the art and typically involves isoelectric focusing along a first dimension followed by SDS- PAGE electrophoresis along a second dimension. See, e.g., Hames et al, , GEL ELECTROPHORESIS OF PROTEINS: A PRACTICAL APPROACH (IRL Press, 1990). The resulting electropherograms can be analyzed by numerous techniques, including mass spectrometric techniques, western blotting and immunoblot analysis using polyclonal and monoclonal antibodies, and internal and N-terminal micro-sequencing.

3. Correlating Gene Expression to Phenotype and Tissue Development

As discussed above, the invention provides methods and tools to correlate gene expression to plant phenotype. Gene expression may be examined in a plant having a phenotype of interest and compared to a plant that does not have the phenotype or has a different phenotype. Such a phenotype includes, but is not limited to, increased drought tolerance, herbicide resistance, reduced or increased height, reduced or increased branching, enhanced cold and frost tolerance, improved vigor, enhanced color, enhanced health and nutritional characteristics, improved storage, enhanced yield, enhanced salt tolerance, enhanced resistance of the wood to decay, enhanced resistance to fungal diseases, altered attractiveness to insect pests, enhanced heavy met al tolerance, increased disease tolerance, increased insect tolerance, increased water-stress tolerance, enhanced sweetness, improved texture, decreased phosphate content, increased germination, increased micronutrient uptake, improved starch composition, improved flower longevity, production of novel resins, and production of novel proteins or peptides.

In another embodiment, the phenotype includes one or more of the following traits: propensity to form reaction wood, a reduced period of juvenility, an increased period of juvenility, self-abscising branches, accelerated reproductive development or delayed reproductive development.

In a further embodiment, the phenotype that is differs in the plants compares includes one or more of the following: lignin quality, lignin structure, wood composition, wood appearance, wood density, wood strength, wood stiffness, cellulose polymerization, fiber dimensions, lumen size, other plant components, plant cell division, plant cell development, number of cells per unit area, cell size, cell shape, cell wall composition, rate of wood formation, aesthetic appearance of wood, formation of stem defects, average microfibril angle, width of the S2 cell wall layer, rate of growth, rate of root formation ratio of root to branch vegetative development, leaf area index, and leaf shape.

Phenotype can be assessed by any suitable means as discussed above.

In a further embodiment, gene expression can be correlated to a given point in the cell cycle, a given point in plant development, and in a given tissue sample. Plant tissue can be examined at different stages of the cell cycle, from plant tissue at different developmental stages, from plant tissue at various times of the year (e.g. spring versus summer), from plant tissues subject to different environmental conditions (e.g. variations in light and temperature) and/or from different types of plant tissue and cells. In accordance with one embodiment, plant tissue is obtained during various stages of maturity and during different seasons of the year. For example, plant tissue can be collected from stem dividing cells, differentiating xylem, early developing wood cells, differentiated spring wood cells, differentiated summer wood cells.

It will be apparent to those skilled in the art that various modifications and variations can be made in the methods and compositions of the present invention without departing from the spirit or scope of the invention. Thus, it is intended that the present invention cover the modifications and variations of this invention provided they come within the scope of the appended claims and their equivalents.

The following examples are given to illustrate the present invention. It should be understood, however, that the invention is not to be limited to the specific conditions or details described in these examples. Throughout the specification, any and all references to a publicly available document, including a U.S. patent, are specifically incorporated by reference.

EXAMPLES

Example 1

Example 1 illustrates a procedure for RNA extraction and purification, which is particularly useful for RNA obtained from conifer needle, xylem, cambium, and phloem.

Tissue is obtained from conifer needle, xylem, cambium or phloem. The tissue is frozen in liquid nitrogen and ground. The total RNA is extracted using Concert Plant RNA reagent (Invitrogen). The resulting RNA sample is extracted into phenol:chloroform and treated with DNase. The RNA is then incubated at 65° C. for 2 minutes followed by centrifugation at 4° C. for 30 minutes. Following centrifugation, the RNA is extracted into phenol at least 10 times to remove contaminants.

The RNA is further cleaned using RNeasy columns (Qiagen). The purified RNA is quantified using RiboGreen reagent (Molecular Probes) and purity assessed by gel electrophoresis.

RNA is then amplified using MessageAmp (Ambion). Aminoallyl-UTP and free UTP are added to the in vitro transcription of the purified RNA at a ratio of 4:1 aminoallyl-UTP-to-UTP. The aminoallyl-UTP is incorporated into the new RNA strand as it is transcribed. The amino-allyl group is then reacted with Cy dyes to attach the calorimetric label to the resulting amplified RNA using the Amersham procedure modified for use with RNA. Unincorporated dye is removed by ethanol precipitation. The labeled RNA is quantified spectrophotometrically (NanoDrop). The labeled RNA is fragmented by heating to 95° C. as described in Hughes et al., *Nature Biotechnol.* 19:342 (2001).

Example 2

Example 2 illustrates how cell cycle genes important for wood development in *Pinus radiata* can be determined and how oligonucleotides which uniquely bind to those genes can be designed and synthesized for use on a microarray.

Pine trees of the species *Pinus radiata* are grown under natural light conditions. Tissue samples are prepared as described in, e.g., Sterky et al., *Proc. Nat'l Acad. Sci.* 95:13330 (1998). Specifically, tissue samples are collected from woody trees having a height of 5 meters. Tissue samples of the woody trees are prepared by taking tangential sections through the cambial region of the stem. The stems are sectioned horizontally into sections ranging from juvenile (top) to mature (bottom). The stem sections separated by stage of development are further separated into 5 layers by peeling into sections of phloem, differentiating phloem, cambium, differentiating xylem, developing xylem, and mature xylem. Tissue samples, including leaves, buds, shoots, and roots are also prepared from seedlings of the species *Pinus radiata*.

RNA is isolated and ESTs generated as described in Example 1 or Sterky et al., supra. The nucleic acid sequences of ESTs derived from samples containing developing wood are compared with nucleic acid sequences of genes known to be involved in the plant cell cycle. ESTs from samples that do not contain developing wood are also compared with sequences of genes known to be involved in the plant cell cycle. An in silico hybridization analysis is performed using BLAST (NCBI). Sequences from among the known cell cycle genes that show hybridization in silico to ESTs made from samples containing developing wood, but that do not hybridize to ESTs from samples not containing developing wood are selected for further examination.

cDNA clones containing sequences that hybridize to the genes showing wood-preferred expression are selected from cDNA libraries using techniques well known in the art of molecular biology. Using the sequence information, oligonucleotides are designed such that each oligonucleotide is specific for only one cDNA sequence in the library. The oligonucleotide sequences are provided in Table 14. 60-mer oligonucleotide probes are designed using the method of Li and Stormo, supra or using software such as ArrayDesigner, GeneScan, and ProbeSelect.

The oligonucleotides are then synthesized in situ described in Hughes et al., *Nature Biotechnol.* 19:324 (2002) or as described in Kane et al., *Nucleic Acids Res.* 28:4552 (2000) and affixed to an activated glass slide (Sigma-Genosis, The Woodlands, Tex.) using a 5' amino linker. The position of each oligonucleotide on the slide is known.

Example 3

Example 3 illustrates how cell cycle genes important for wood development in *Eucalyptus grandis* can be determined and how oligonucleotides which uniquely bind to those genes can be designed and synthesized for use on a microarray.

*Eucalyptus* trees of the species *Eucalyptus grandis* are grown under natural light conditions. Tissue samples are prepared as described in, e.g., Sterky et al., *Proc. Nat'l Acad. Sci.* 95:13330 (1998). Specifically, tissue samples are collected from woody trees having a height of 5 meters. Tissue samples of the woody trees are prepared by taking tangential sections through the cambial region of the stem. The stems are sectioned horizontally into sections ranging from juvenile (top) to mature (bottom). The stem sections separated by stage of development are further separated into 5 layers by peeling into sections of phloem, differentiating phloem, cambium, differentiating xylem, developing xylem, and mature xylem. Tissue samples, including leaves, buds, shoots, and roots are also prepared from seedlings of the species *Pinus radiata*.

RNA is isolated and ESTs generated as described in Example 1 or Sterky et al., supra. The nucleic acid sequences of ESTs derived from samples containing developing wood are compared with nucleic acid sequences of genes known to be involved in the plant cell cycle. ESTs from samples that do not contain developing wood are also compared with sequences of genes known to be involved in the plant cell cycle. An in silico hybridization analysis is performed as described in, for example, Audic and Claverie, *Genome Res.* 7:986 (1997). Sequences from among the known cell cycle genes that show hybridization in silico to ESTs made from samples containing developing wood, but do not hybridize to ESTs from samples not containing developing wood are selected for further examination.

cDNA clones containing sequences that hybridize to the genes showing wood-preferred expression are selected from cDNA libraries using techniques well known in the art of molecular biology. Using the sequence information, oligonucleotides are designed such that each oligonucleotide is specific for only one cDNA sequence in the library. The oligonucleotide sequences are provided in Table 14. 60-mer oligonucleotide probes are designed using the method of Li and Stormo, supra or using software such as ArrayDesigner, GeneScan, and ProbeSelect.

The oligonucleotides are then synthesized in situ described in Hughes et al., *Nature Biotechnol.* 19:324 (2002) or as described in Kane et al., *Nucleic Acids Res.* 28:4552 (2000) and affixed to an activated glass slide (Sigma-Genosus, The Woodlands, Tex.) using a 5' amino linker. The position of each oligonucleotide on the slide is known.

Example 4

Example 4 illustrates how to detect expression of *Pinus radiata* cell cycle genes which are important in wood formation using an oligonucleotide microarray prepared as in Example 2. This is an example of a balanced incomplete block designed experiment carried out using aRNA samples prepared from mature-phase phloem (P), cambium (C), expanding xylem found in a layer below the cambium (X1) and differentiating, lignifying xylem cells found deeper in the same growth ring (X2). In this example, cell cycle gene expression is compared among the four samples, namely P, C, X1, and X2.

In the summer, plants of the species *Pinus radiata* are felled and the bark of the main stem is immediately pulled gently away to reveal the phloem and xylem. The phloem and xylem are then peeled with a scalpel into separate containers of liquid nitrogen. Needles (leaves) and buds from the trees are also harvested with a scalpel into separate containers of liquid nitrogen. RNA is subsequently isolated from the frozen tissue samples as described in Example 1. Equal microgram quantities of total RNA are purified from each sample using RNeasy Mini columns (Qiagen, Valencia, Calif.) according to the manufacturer's instructions.

Amplification reactions are carried out for each of the P, C, X1, and X2 tissue samples. Amplification reactions are performed using Ambion's MessageAmp kit, a T7-based amplification procedure, following the manufacturer's instructions, except that labeled aaUTP is added to the reagent mix during in the amplification step. aaUTP is incorporated into the resulting antisense RNA formed during this step. CyDye fluorescent labels are coupled to the aaUTPs in a non-enzymatic reaction as described in Example 1. Labeled amplified antisense RNAs are precipitated and washed, and then assayed for purity using a NanoDrop spectrophotometer. These labeled antisense RNAs, corresponding to the RNA isolated from the P, C, X1, and X2 tissue samples, constitute the sample nucleic acids, which are referred to as the P, C, X1, and X2 samples.

Normalization control samples of known nucleic acids are added to each sample in a dilution series of 500, 200, 100, 50, 25 and 10 pg/µl for quantitation of the signals. Positive controls corresponding to specific genes showing expression in all tissues of pine, such as housekeeping genes, are also added to the plant sample.

Each of four microarray slides is incubated with 125 µL of a P, C, X1 or X2 sample under a coverslip at 42° C. for 16-18 hours. The arrays are washed in 1×SSC, 0.1% SDS for 10 minutes and then in 0.1×SSC, 0.1% SDS for 10 minutes and the allowed to dry.

The array slides are scanned using an Axon laser scanner and analyzed using GenePix Pro software. Data from the microarray slides are subjected to microarray data analysis using GenStat SAS or Spotfire software. Outliers are removed and ratiometric data for each of the datasets are normalized using a global normalization which employs a cubic spline fit applied to correct for differential dye bias and spatial effects. A second transformation is performed to fit control signal ratios to a mean $\log^2=0$ (i.e. 1:1 ratio). Normalized data are then subjected to a variance analysis.

Mean signal intensity for each signal at any given position on the microarray slide is determined for each of three of P, C, X1, and X2 sample microarray slides. This mean signal/probe position is compared to the signal at the same position on sample slide which was not used for calculating the mean. For example, a mean signal at a given position is determined for P, C, and X1 and the signal at that position in the X2 microarray slide is compared to the P, C, and X1 mean signal value.

Table 1 shows genes having greater than doubled signal with any one sample as compared to the mean signal of the other three samples.

TABLE 1

| Gene | PvCX12 | PvX12 | CvX12 |
| --- | --- | --- | --- |
| WD40 repeat protein A | −1.24 | −0.88 | −1.07 |
| CDC2 | −1.09 | −0.78 | −0.92 |
| CYCLIN | −1.08 | −1 | −0.26 |
| WD-40 repeat protein B | −1.01 | −0.87 | −0.42 |
| CDC2 | −0.83 | −0.49 | −1.01 |

P = Phloem
C = Cambium
X1 = xylem layer-1
X2 = xylem layer-2
PvCX12 = Ratio of the signal for Phloem target versus mean signal for Cambium, Xylem1, and Xylem2 targets The data shows that WD40 repeat protein A encodes a WD40 repeat protein is less highly expressed in cambium than in developing xylem, while WD40 repeat protein B encodes a WD40 repeat protein that is more highly expressed in phloem than in the other tissues.

Signal data are then verified with RT-PCR to confirm gene expression in the target tissue of the genes corresponding to the unique oligonucleotides in the probe.

Example 5

Example 5 demonstrates how one can correlate cell cycle gene expression with agronomically important wood phenotypes such as density, stiffness, strength, distance between branches, and spiral grain.

Mature clonally propagated pine trees are selected from among the progeny of known parent trees for superior growth characteristics and resistance to important fungal diseases. The bark is removed from a tangential section and the trees are examined for average wood density in the fifth annual ring at breast height, stiffness and strength of the wood, and spiral grain. The trees are also characterized by their height, mean distance between major branches, crown size, and forking.

To obtain seedling families that are segregating for major genes that affect density, stiffness, strength, distance between branches, spiral grain and other characteristics that may be linked to any of the genes affecting these characteristics, trees lacking common parents are chosen for specific crosses on the criterion that they exhibit the widest variation from each other with respect to the density, stiffness, strength, distance between branches, and spiral grain criteria. Thus, pollen from a plus tree exhibiting high density, low mean distance between major branches, and high spiral grain is used to pollinate cones from the unrelated plus tree among the selections exhibiting the lowest density, highest mean distance between major branches, and lowest spiral grain. It is useful to note that "plus trees" are crossed such that pollen from a plus tree exhibiting high density are used to pollinate developing cones from another plus tree exhibiting high density, for example, and pollen from a tree exhibiting low mean distance between major branches would be used to pollinate developing cones from another plus tree exhibiting low mean distance between major branches.

Seeds are collected from these controlled pollinations and grown such that the parental identity is maintained for each seed and used for vegetative propagation such that each genotype is represented by multiple ramets. Vegetative propagation is accomplished using micropropagation, hedging, or fascicle cuttings. Some ramets of each genotype are stored while vegetative propagules of each genotype are grown to sufficient size for establishment of a field planting. The genotypes are arrayed in a replicated design and grown under field conditions where the daily temperature and rainfall are measured and recorded.

The trees are measured at various ages to determine the expression and segregation of density, stiffness, strength, distance between branches, spiral grain, and any other observable characteristics that may be linked to any of the genes affecting these characteristics. Samples are harvested for characterization of cellulose content, lignin content, cellulose microfibril angle, density, strength, stiffness, tracheid morphology, ring width, and the like. Samples are also examined for gene expression as described in Example 4. Ramets of each genotype are compared to ramets of the same genotype at different ages to establish age:age correlations for these characteristics.

Example 6

Example 6 demonstrates how the stage of plant development and responses to environmental conditions such as light and season can be correlated to cell cycle gene expression using microarrays prepared as in Example 4. In particular, the changes in gene expression associated with wood density are examined.

Trees of three different clonally propagated *Eucalyptus grandis* hybrid genotypes are grown on a site with a weather station that measures daily temperatures and rainfall. During the spring and subsequent summer, genetically identical ramets of the three different genotypes are first photographed with north-south orientation marks, using photography at sufficient resolution to show bark characteristics of juvenile and mature portions of the plant, and then felled as in Example 4. The age of the trees is determined by planting records and confirmed by a count of the annual rings. In each of these trees, mature wood is defined as the outermost rings of the tree below breast height, and juvenile wood as the innermost rings of the tree above breast height. Each tree is accordingly sectored as follows:

NM—NORTHSIDE MATURE
SM—SOUTHSIDE MATURE
NT—NORTHSIDE TRANSITION
ST—SOUTHSIDE TRANSITION
NJ—NORTHSIDE JUVENILE
SJ—SOUTHSIDE JUVENILE

Tissue is harvested from the plant trunk as well as from juvenile and mature form leaves. Samples are prepared simultaneously for phenotype analysis, including plant morphology and biochemical characteristics, and gene expression analysis. The height and diameter of the tree at the point from which each sector was taken is recorded, and a soil sample from the base of the tree is taken for chemical assay. Samples prepared for gene expression analysis are weighed and placed into liquid nitrogen for subsequent preparation of RNA samples for use in the microarray experiment. The tissues are denoted as follows:

P—phloem
C—cambium
X1—expanding xylem
X2—differentiating and lignifying xylem

Thin slices in tangential and radial sections from each of the sectors of the trunk are fixed as described in Ruzin, Plant Microtechnique and Microscopy, Oxford University Press, Inc., New York, N.Y. (1999) for anatomical examination and confirmation of wood developmental stage. Microfibril angle is examined at the different developmental stages of the wood, for example juvenile, transition and mature phases of *Eucalyptus grandis* wood. Other characteristics examined are the ratio of fibers to vessel elements and ray tissue in each sector. Additionally, the samples are examined for characteristics that change between juvenile and mature wood and between spring wood and summer wood, such as fiber morphology, lumen size, and width of the S2 (thickest) cell wall layer. Samples are further examined for measurements of density in the fifth ring and determination of modulus of elasticity using techniques well known to those skilled in the art of wood assays. See, e.g., Wang, et al., *Non-destructive Evaluations of Trees*, EXPERIMENTAL TECHNIQUES, pp. 28-30 (2000).

For biochemical analysis, 50 grams from each of the harvest samples are freeze-dried and analyzed, using biochemical assays well known to those skilled in the art of plant biochemistry for quantities of simple sugars, amino acids, lipids, other extractives, lignin, and cellulose. See, e.g., Pettersen & Schwandt, *J. Wood Chem. & Technol.* 11:495 (1991).

In the present example, the phenotypes chosen for comparison are high density wood, average density wood, and low density wood. Nucleic acid samples are prepared as described in Example 3, from trees harvested in the spring and summer. Gene expression profiling by hybridization and data analysis is performed as described in Examples 3 and 4.

Using similar techniques and clonally propagated individuals one can examine cell cycle gene expression as it is related to other complex wood characteristics such as strength, stiffness and spirality.

Example 7

Example 7 demonstrates the ability of the oligonucleotide probes of the invention to distinguish between highly homologous members of a family of cell cycle genes. Hybridization to a particular oligonucleotide on the array identifies a unique WD40 gene that is expressed more strongly in a genotype having a higher density wood than in observed in other genotypes examined. The WD40 gene is also expressed more strongly in mature wood than in juvenile wood and more strongly in summer wood than in spring wood. This gene is not found to be expressed at high levels either in leaves or buds.

The gene expression pattern is confirmed by RT-PCR. This gene, the putative "density-related" gene, is used for in situ hybridization of fixed radial sections. The density-related WD40 gene hybridizes most strongly to the vascular cambium in regions of the stem where the xylem is comprised primarily of fibers with few vessel elements and few xylem ray cells.

These results suggest that the WD40 gene product functions in radial cell division, which occurs in the cambium and results in diameter growth, rather than in axial cell division such as may be important in the apex or leaves. Such a gene would be difficult to identify by cDNA microarrays or other traditional hybridization means because the highly conserved regions present in the gene would result in confusing it with genes encoding enzymes having similar catalytic functions, but acting in axial or radial divisions. Furthermore, from the sequence similarity-based annotation suggesting a function of this gene product in cell division and the observation of this microarray hybridization pattern, confirmed by RT-PCR and in silico hybridization, this gene product functions specifically in developing secondary xylem to guide the cell division patterns of fibers, such that higher expression of this gene results in greater fiber production relative to vessel element or ray production. The fiber content is correlated with a principal components analysis (PCA) variable that accounts for at least 10% of the variation in basic density.

Example 8

Example 8 demonstrates how the use of oligonucleotide probes of the invention can be used to identify one wood "density related" WD40 repeat protein gene and its promoter from among the family of homologous genes. Further, this example demonstrates how a promoter sequence identified using this method is used to transform other hardwood species to result in increased diameter growth rates as compared to wild-type plants of the same species.

The sequence of the WD40 gene is used to probe a Genome Walker library in order to isolate 5' flanking sequences comprising a promoter region. The promoter region is then operably linked to a beta-glucuronidase reporter gene and cloned into a binary vector for transformation into *Eucalyptus* using the method described in U.S. Application Ser. No. 60/476, 222. Regenerated transgenic tobacco and *Eucalyptus* plants are then sectioned and stained using X-gluc, demonstrating that the microarray data results in isolation of a promoter capable of highly cambial-specific expression solely in those portions of the stem that develop more fibers than vessel elements or xylem rays.

Using techniques well known to those skilled in the art of molecular biology, the promoter is then operably linked to a cell division promoting gene and this construct placed in a binary vector for transformation into hardwood plants such as Sweetgum and Populus, such that the cell division promoting gene is expressed more strongly than normally in the vascular cambium. This results in increased diameter growth rate in the transgenic hardwood plants relative to control hardwood plants.

Example 9

Example 9 demonstrates how a density related polypeptide can be linked to a tissue-preferred promoter and expressed in pine resulting in a plant with increased wood density.

A density-related polypeptide, which is more highly expressed during the early spring, is identified by the method described in Example 7. A DNA construct having the density-related polypeptide operably linked to a promoter is placed into an appropriate binary vector and transformed into pine using the method of Connett et al. U.S. patent application Ser. Nos. 09/973,088 and 09/973,089). Pine plants are transformed as described in Connett et al., supra, and the transgenic pine plants are used to establish a forest planting. Increased density even in the spring wood (early wood) is observed in the transgenic pine plants relative to control pine plants which are not transformed with the density related DNA construct.

Example 10

Using techniques well known to those skilled in the art of molecular biology, the sequence of the putative density-related gene isolated in Example 7 is analyzed in genomic DNA isolated from alfalfa. This enables the identification of an orthologue in alfalfa whose sequence is then used to create an RNAi knockout construct. This construct is then transformed into alfalfa. See, e.g., Austin et al., *Euphytica* 85, 381 1995. The regenerated transgenic plants show lower fiber content and increased ray cells content in the xylem. Such properties improved digestability which results in higher growth rates in cattle fed on this alfalfa as compared to wild-type alfalfa of the same species.

Example 11

Example 11 demonstrates how gene expression analysis can be used to find gene variants which are present in mature plants having a desirable phenotype. The presence or absence of such a variant can be used to predict the phenotype of a mature plant, allowing screening of the plants at the seedling stage. Although this example employs eucalyptus, the method used herein is also useful in breeding programs for pine and other tree species.

The sequence of a putative density-related gene is used to probe genomic DNA isolated from *Eucalyptus* that vary in density as described in previous examples. Non-transgenically produced *Eucalyptus* hybrids of different wood phenotypes are examined. One hybrid exhibits high wood density and another hybrid exhibits lower wood density. A molecular marker in the 3' portion of the coding region is found which distinguishes a high-density gene variant from a lower density gene variant.

This molecular marker enables tree breeders to assay non-transgenic *Eucalyptus* hybrids for likely density profiles while the trees are still at seedling stage, whereas in the absence of the marker, tree breeders must wait until the trees have grown for multiple years before density at harvest age can be reliably predicted. This enables selective outplanting of the best trees at seedling stage rather than an expensive culling operation and resultant erosion at thinning age. This molecular marker is further useful in the breeding program to determine which parents will give rise to high density outcross progeny.

Molecular markers found in the 3' portion of the coding region of the gene that do not correspond to variants seen more frequently in higher or lower wood density non-transgenic *Eucalyptus* hybrid trees are also useful. These markers are found to be useful for fingerprinting different genotypes of *Eucalyptus*, for use in identity-tracking in the breeding program and in plantations.

Example 12

This Example describes microarrays for identifying gene expression differences that contribute to the phenotypic characteristics that are important in commercial wood, namely wood appearance, stiffness, strength, density, fiber dimensions, coarseness, cellulose and lignin content, extractives content and the like.

As in Examples 2-4, woody trees of genera that produce commercially important wood products, in this case *Pinus* and *Eucalyptus*, are felled from various sites and at various times of year for the collection and isolation of RNA from developing xylem, cambium, phloem, leaves, buds, roots, and other tissues. RNA is also isolated from seedlings of the same genera.

All contigs are compared to both the ESTs made from RNA isolated from samples containing developing wood and the sequences of the ESTs made from RNA of various tissues that do not contain developing wood. Contigs containing primarily ESTs that show more hybridization in silico to ESTs made from RNA isolated from samples containing developing wood than to ESTs made from RNA isolated from samples not containing developing wood are determined to correspond to possible novel genes particularly expressed in developing wood. These contigs are then used for BLAST searches against public domain sequences. Those contigs that hybridize with high stringency to no known genes or genes annotated as having only a "hypothetical protein" are selected for the next step. These contigs are considered putative novel genes showing wood-preferred expression.

The longest cDNA clones containing sequences hybridizing to the putative novel genes showing wood-preferred expression are selected from cDNA libraries using techniques well known to those skilled in the art of molecular biology. The cDNAs are sequenced and full-length gene-coding sequences together with untranslated flanking sequences are obtained where possible. Stretches of 45-80 nucleotides (or oligonucleotides) are selected from each of the sequences of putative novel genes showing wood-preferred expression such that each oligonucleotide probe hybridizes at high stringency to only one sequence represented in the ESTs made from RNA isolated from trees or seedlings of the same genus.

Oligomers are then chemically synthesized and placed onto a microarray slide as described in Example 3. Each oligomer corresponds to a particular sequence of a putative novel gene showing wood-preferred expression and to no other gene whose sequence is represented among the ESTs made from RNA isolated from trees or seedlings of the same genus.

Sample preparation and hybridization are carried out as in Example 4. The technique used in this example is more effective than use of a microarray using cDNA probes because the presence of a signal represents significant evidence of the expression of a particular gene, rather than of any of a number of genes that may contain similarities to the cDNA due to conserved functional domains or common evolutionary history. Thus, it is possible to differentiate homologous genes, such as those in the same family, but which may have different functions in phenotype determination.

Thus hybridization data, gained using the method of Example 4, enable the user to identify which of the putative novel genes actually has a pattern of coordinate expression with known genes, a pattern of expression consistent with a particular developmental role, and/or a pattern of expression that suggests that the gene has a promoter that drives expression in a valuable way.

The hybridization data thus using this method can be used, for example, to identify a putative novel gene that shows an expression pattern particular to the tracheids with the lowest cellulose microfibril angle in developing spring wood (early wood). The promoter of this gene can also be isolated as in Example 8, and operably linked to a gene that has been shown as in Example 9 to be associated with late wood (summer wood). Transgenic pine plants containing this construct are generated using the methods of Example 9, and the early wood of these plants is then shown to display several characteristics of late wood, such as higher microfibril angle, higher density, smaller average lumen size, etc.

Example 13

Example 13 demonstrates the use of a cambium-specific promoter functionally linked to a cell cycle gene for increased plant biomass.

Cambium-specific cell cycle transcripts are identified via array analyses of different secondary vasculature layers as described in Example 4. Candidate promoters linked to the genes corresponding to these transcripts are cloned from pine genomic DNA using, e.g., the BD Clontech GenomeWalker kit and tested in transgenic tobacco via a reporter assay(s) for cambium specificity/preference. The cambium-specific promoter overexpressing a cell cycle gene involved in secondary xylem cell division is used to increased wood biomass. A tandem cambium-specific promoter is constructed driving the cell cycle ORF. Boosted transcript levels of the candidate cell cycle gene result in an increased xylem biomass phenotype.

Example 14

Isolation and Characterization of cDNA Clones from *Eucalyptus grandis*

*Eucalyptus grandis* cDNA expression libraries were prepared from mature shoot buds, early wood phloem, floral tissue, leaf tissue (two independent libraries), feeder roots, structural roots, xylem or early wood xylem and were constructed and screened as follows.

Total RNA was extracted from the plant tissue using the protocol of Chang et al. (*Plant Molecular Biology Reporter* 11:113-116 (1993). mRNA was isolated from the total RNA preparation using either a Poly(A) Quik mRNA Isolation Kit (Stratagene, La Jolla, Calif.) or Dynal Beads Oligo $(dT)_{25}$ (Dynal, Skogen, Norway). A cDNA expression library was constructed from the purified mRNA by reverse transcriptase synthesis followed by insertion of the resulting cDNA clones in Lambda ZAP using a ZAP Express cDNA Synthesis Kit (Stratagene), according to the manufacturer's protocol. The resulting cDNAs were packaged using a Gigapack II Packaging Extract (Stratagene) using an aliquot (1-5 αl) from the 5 μl ligation reaction dependent upon the library. Mass excision of the library was done using XL1-Blue MRF' cells and XLOLR cells (Stratagene) with ExAssist helper phage (Stratagene). The excised phagemids were diluted with NZY broth (Gibco BRL, Gaithersburg, Md.) and plated out onto LB-kanamycin agar plates containing X-gal and isopropylthio-beta-galactoside (IPTG).

Of the colonies plated and selected for DNA miniprep, 99% contained an insert suitable for sequencing. Positive colonies were cultured in NZY broth with kanamycin and cDNA was purified by means of alkaline lysis and polyethylene glycol (PEG) precipitation. Agarose gel at 1% was used to screen sequencing templates for chromosomal contamination. Dye primer sequences were prepared using a Turbo Catalyst 800 machine (Perkin Elmer/Applied Biosystems Division, Foster City, Calif.) according to the manufacturer's protocol.

DNA sequence for positive clones was obtained using a Perkin Elmer/Applied Biosystems Division Prism 377 sequencer. cDNA clones were sequenced first from the 5' end and, in some cases, also from the 3' end. For some clones, internal sequence was obtained using either Exonuclease III deletion analysis, yielding a library of differentially sized subclones in pBK-CMV, or by direct sequencing using gene-specific primers designed to identified regions of the gene of interest.

The determined cDNA sequences were compared with known sequences in the EMBL database using the computer algorithms FASTA and/or BLASTN. Multiple alignments of redundant sequences were used to build reliable consensus sequences. Based on similarity to known sequences from other plant species, the isolated polynucleotide sequences were identified as encoding transcription factors, as detailed herein. The predicted polypeptide sequences corresponding to the polynucleotide sequences are also depicted therein.

Example 15

Isolation and Characterization of cDNA Clones from *Pinus radiata*

*Pinus radiata* cDNA expression libraries (prepared from either shoot bud tissue, suspension cultured cells, early wood phloem (two independent libraries), fascicle meristem tissue, male strobilus, root (unknown lineage), feeder roots, structural roots, female strobilus, cone primordia, female receptive cones and xylem (two independent libraries) were constructed and screened as described above in Example 14.

DNA sequence for positive clones was obtained using forward and reverse primers on a Perkin Elmer/Applied Biosystems Division Prism 377 sequencer and the determined sequences were compared to known sequences in the database as described above.

Based on similarity to known sequences from other plant species, the isolated polynucleotide sequences were identified as encoding transcription factors, as detailed herein. The predicted polypeptide sequences corresponding to the polynucleotide sequences are also depicted therein.

Example 16

5' RACE Isolation

To identify additional sequence 5' or 3' of a partial cDNA sequence in a cDNA library, 5' and 3' rapid amplification of cDNA ends (RACE) was performed. using the SMART RACE cDNA amplification kit (Clontech Laboratories, Palo Alto, Calif.). Generally, the method entailed first isolating poly(A) mRNA, performing first and second strand cDNA synthesis to generate double stranded cDNA, blunting cDNA ends, and then ligating of the SMART RACE. Adaptor to the cDNA to form a library of adaptor-ligated ds cDNA. Gene-specific primers were designed to be used along with adaptor specific primers for both 5' and 3' RACE reactions. Using 5' and 3' RACE reactions, 5' and 3' RACE fragments were obtained, sequenced, and cloned. The process may be repeated until 5' and 3' ends of the full-length gene were identified. A full-length cDNA may generated by PCR using primers specific to 5' and 3' ends of the gene by end-to-end PCR.

For example, to amplify the missing 5' region of a gene from first-strand cDNA, a primer was designed 5'→3' from the opposite strand of the template sequence, and from the region between ~100-200 bp of the template sequence. A successful amplification should give an overlap of ~100 bp of DNA sequence between the 5' end of the template and PCR product.

RNA was extracted from four pine tissues, namely seedling, xylem, phloem and structural root using the Concert Reagent Protocol (Invitrogen, Carlsbad, Calif.) and standard isolation and extraction procedures. The resulting RNA was then treated with DNase, using 10 U/ul DNase I (Roche Diagnostics, Basel, Switzerland). For 100 μg of RNA, 9 μl 10×DNase buffer (Invitrogen, Carlsbad, Calif.), 10 μl of Roche DNase I and 90 μl of Rnase-free water was used. The RNA was then incubated at room temperature for 15 minutes and 1/10 volume 25 mM EDTA is added. A RNeasy mini kit (Qiagen, Venlo, The Netherlands) was used for RNA clean up according to manufacturer's protocol.

To synthesize cDNA, the extracted RNA from xylem, phloem, seedling and root was used and the SMART RACE cDNA amplification kit (Clontech Laboratories Inc, Palo Alto, Calif.) was followed according to manufacturer's protocol. For the RACE PCR, the cDNA from the four tissue types was combined. The master mix for PCR was created by combining equal volumes of cDNA from xylem, phloem, root and seedling tissues. PCR reactions were performed in 96 well PCR plates, with 1 μl of primer from primer dilution plate (10 mM) to corresponding well positions. 49 μl of master mix is aliquoted into the PCR plate with primers. Thermal cycling commenced on a GeneAmp 9700 (Applied Biosystems, Foster City, Calif.) at the following parameters:

94° C. (5 sec),
72° C. (3 min), 5 cycles;
94° C. (5 sec),
70° C. (10 sec),
72° C. (3 min), 5 cycles;
94° C. (5 sec),
68° C. (10 sec),
72° C. (3min), 25 cycles.

cDNA was separated on an agarose gel following standard procedures. Gel fragments were excised and eluted from the gel by using the Qiagen 96-well Gel Elution kit, following the manufacturer's instructions.

PCR products were ligated into pGEMTeasy (Promega, Madison, Wis.) in a 96 well plate overnight according to the following specifications: 60-80 ng of DNA, 5 μl 2× rapid ligation buffer, 0.5 μl pGEMT easy vector, 0.1 μl DNA ligase, filled to 10 μl with water, and incubated overnight.

Each clone was transformed into *E.coli* following standard procedures and DNA was extracted from 12 clones picked by following standard protocols. DNA extraction and the DNA quality was verified on an 1% agarose gel. The presence of the correct size insert in each of the clones was determined by restriction digests, using the restriction endonuclease EcoRI, and gel electrophoresis, following standard laboratory procedures.

Example 17

Curation of an EST Sequence.

During the production of cDNA libraries, the original transcripts or their DNA counterparts may have features that prevent them from coding for functional proteins. There may be insertions, deletions, base substitutions, or unspliced or improperly spliced introns. If such features exist, it is often possible to identify them so that they can be changed. Similar curation can be performed on any other sequences that have homology to sequences in the public databases.

After determination of the DNA sequence, BLAST analysis shows that it is related to an *Arabidopsis* gene on the publicly available *Arabidopsis* genome sequence). However, instead of coding for an approximately 240 amino acid polypeptide, the consensus being curated is predicted to code for a product of only 157 amino acid residues, suggesting an error in the DNA sequence. To identify where the genuine coding region might be, the DNA sequence to the end of each EST is translated in each of the three reading frames and the predicted sequences are aligned with the Arabidopsis gene's amino acid sequence. It is found that the DNA segment in one portion of the EST codes for a sequence with similarity to the carboxyl terminus of the *Arabidopsis* gene. Therefore, it appears that an unspliced intron is present in the EST.

Unspliced introns are a relatively minor issue with regard to use of a cloned sequence for overexpression of the gene of interest. The RNA resulting from transcription of the cDNA can be expected to undergo normal processing to remove the intron. Antisense and RNAi constructs are also expected to function to suppress the gene of interest. On other occasions, it may be desirable to identify the precise limits of the intron so that it can be removed. When the sequence in question has a published sequence that is highly similar, it may be possible to find the intron by aligning the two sequences and identifying the locations where the sequence identity falls off, aided by the knowledge that introns start with the sequence GT and end with the sequence AG.

When there is some doubt about the site of the intron because highly similar sequences are not available, the intron location can be verified experimentally. For example, DNA oligomers can be synthesized flanking the region where the suspected intron is located. RNA from the source species, either *Pinus* or *Eucalyptus*, is isolated and used as a template to make cDNA using reverse transcriptase. The selected primers are then used in a PCR reaction to amplify the correctly spliced DNA segment (predicted size of approximately 350 bp smaller than the corresponding segment of the original consensus) from the population of cDNAs. The amplified segment is then subjected to sequence analysis and compared to the consensus sequence to identify the differences.

The same procedure can be used when an alternate splicing event (partial intron remaining, or partial loss of an exon) is suspected. When an EST has a small change, such as insertion or deletion of a small number of bases, computer analysis of the EST sequence can still indicate its location when a translation product of the wrong size is predicted or if there is an obvious frameshift. Verification of the true sequence is done by synthesis of primers, production of new cDNA, and PCR amplification as described above.

Example 18

Transformation of *Populus deltoides* with constructs containing cell cycle genes.

Constructs made as described in the preceding example and shown in Table 2 below were each inoculated into *Agrobacterium* cultures by standard techniques.

Table 2 identifes plasmid(s), genes, and Genesis ID numbers for constructions described in Example 17.

TABLE 2

| Plasmid(s) | Gene | Genesis ID |
| --- | --- | --- |
| pGrw14 | Cyclin A | prga001823 |
| pGrw15 | Cyclin A | prpe001264 |
| pGrw16 | Cyclin D | prxa004540 |
| pGrw18 | Cyclin D | prxl006271 |
| PGrw19 | Cyclin D | prpb019661 |
| PGrw20 | WEE1-like protein | prrd041233 |

*Populus deltoides* stock plant cultures were maintained on DKW medium (Driver and Kuniyuki, 1984, McGranahan et al. 1987, available commercially from Sigma/Aldrich) with 2.5 uM zeatin in a growth room with a 16 h photoperiod. For transformation, petioles were excised aseptically using a sharp scalpel blade from the stock plants, cut into 4-6 mm lengths, placed on DKW medium with 1 ug/ml BAP and 1 ug/ml NAA immediately after harvest, and incubated in a dark growth chamber (28 degrees) for 24 hours.

*Agrobacterium* cultures containing the desired constructs were grown to log phase, indicated by an OD600 between 0.8-1.0 A, then pelleted and resuspended in an equal volume of *Agrobacterium* Induction Medium (AIM), which contains Woody Plant Medium salts (Lloyd, G., and McCown, B., 1981. Woody plant medium. Proc. Intern. Plant Prop. Soc. 30:421, available commercially from Sigma/Aldrich), 5 g/L glucose and 0.6 g/L MES at pH 5.8, with the addition of 1 ul of a 100 mM stock solution of acetosyringone per ml of AIM. The pellet was resuspended by vortexing. The bacterial cells were incubated for an hour in this medium at 28 degrees C. in an environmental chamber, shaking at 100 rpm.

After the induction period, *Populus deltoides* explants were exposed to the *Agrobacterium* mixture for 15 minutes. The explants were then lightly blotted on sterile paper towels, replaced onto the same plant medium and cultured in the dark at 18-20 degrees C. After a three-day co-cultivation period, the explants were transferred to DKW medium in which the NAA concentration was reduced to 0.1 ug/ml and to which was added 400 mg/L timentin to eradicate the *Agrobacterium*.

After 4 days on eradication medium, explants were transferred to small magenta boxes containing the same medium supplemented with timentin (400 mg/L) as well as the selection agent geneticin (50 mg/L). Explants were transferred every two weeks to fresh selection medium. Calli that grow in the presence of selection were isolated and sub-cultured to fresh selection medium every three weeks. Calli were observed for the production of adventitious shoots.

Adventitious shoots were normally observed within two months from the initiation of transformation. These shoot clusters were transferred to DKW medium to which no NAA was added, and in which the BAP concentration was reduced to 0.5 ug.ml, for shoot elongation, typically for about 14 weeks. Elongated shoots were excised and transferred to BTM medium (Chalupa, Communicationes Instituti Forestalis Checosloveniae 13:7-39, 1983, available commercially from Sigma/Aldrich) at pH5.8, containing 20 g/l sucrose and 5 g/l activated charcoal. See Table 3 below.

TABLE 3

Rooting medium for *Populus deltoids*.

| BTM-1 Media Components | mg/L |
|---|---|
| $NH_4NO_3$ | 412 |
| $KNO_3$ | 475 |
| $Ca(NO_3)_2 \cdot 4H_2O$ | 640 |
| $CaCl_2 \cdot 2H_2O$ | 440* |
| $MgSO_4 \cdot 7H_2O$ | 370 |
| $KH_2PO_4$ | 170 |
| $MnSO_4 \cdot H_2O$ | 2.3 |
| $ZnSO_4 \cdot 7H_2O$ | 8.6 |
| $CuSO_4 \cdot 5H_2O$ | 0.25 |
| $CoCl_2 \cdot 6H_2O$ | 0.02 |
| KI | 0.15 |
| $H_3BO_3$ | 6.2 |
| $Na_2MoO_4 \cdot 2H_2O$ | 0.25 |
| $FeSO_4 \cdot 7H_2O$ | 27.8 |
| $Na_2EDTA \cdot 2H_2O$ | 37.3 |
| Myo-inositol | 100 |
| Nicotinic acid | 0.5 |
| Pyridoxine HCl | 0.5 |
| Thiamine HCl | 1 |
| Glycine | 2 |
| Sucrose | 20000 |
| Activated Carbon | 5000 |

After development of roots, typically four weeks, transgenic plants were propagated in the greenhouse by rooted cutting methods, or in vitro through axillary shoot induction for four weeks on DKW medium containing 11.4 uM zeatin, after which the multiplied shoots were separated and transferred to root induction medium. Rooted plants were transferred to soil for evaluation of growth in glasshouse and field conditions.

Example 19

Production of disproportionately large leaves mediated by ectopic expression of certain cyclin D genes Approximately 100 explants of *Populus deltoides* per construct were transformed with pGRW16 and pGRW19, which contain genes that are normally show preferred expression in the vasculature, driven by a constitutive promoter (the *Pinus radiata* superubiquitin promoter). Upon regeneration, many of the ramets of many of the translines were observed to have disproportionately large leaves relative to control plants. The leaves were both longer and broader than those of control plants.

Disproportionately large leaves could be a very useful early indicator of growth potential. large leaf size and thus high growth potential. Lage leaf size can be a function of either increased numbers of leaf cells or increased leaf cell size or both.

Example 20

Production of unusual vascular development mediated by ectopic expression of a cyclin D gene.

Approximately 100 explants of *Populus deltoides* per construct were transformed with pGRW18. Multiple transgenic lines regenerated from this experiment showed a very unique pleiotropic phenotype. Leaves of these transgenic lines symmetrically folded on both sides of the midrib down the entire length of the leaf. Many petioles of these lines spiraled, and in many cases turned 360 degrees, in a right-handed fashion towards the leaf. The stem showed some thickening and slight bending near the middle.

One ramet of the transgenic line TDL002534 showing these phenotypes was sacrificed to investigate these aberrancies at the tissue level. Transverse sections of a curling petiole stained with toluidine blue revealed retardation of vascular development, but the presence of additional vascular cylinders developing as indicated by the black arrows. The xylem and phloem within the vascular cylinders of the curling petiole appeared to be developmentally similar and spatially oriented correctly. Longitudinal sections of straight and curled petioles may offer an explanation for the spiraling phenomenon. Curled petioles showed more elongated cells on the outside turn of the curl and more compressed cells on the opposite side of the petiole.

Perhaps the most striking phenotype was identified in the leaves. As with the petioles, aberrant vascular development was noted, comprising additional forming vascular cylinders lateral to the larger midrib. In some sections almost fully-formed veins could be seen immediately adjacent to the midrib. In all instances where the folding phenotype was noted, this type of leaf configuration was associated with the phenotype.

The development of additional vascular cylinders in the space where normally a small number of vascular bundles or a single midrib are seen is indicative of unusual cell division activity at the level of early vascular development. Thus, this gene expressed under the control of a vascular-preferred promoter rather than a constitutive promoter could have utility in increasing cell division in later vascular development, creating additional wood.

Example 21

This example illustrates how polynucleotides important for wood development in *P. radiata* can be determined and how oligonucleotides which uniquely bind to those genes can be designed and synthesized for use on a microarray.

Open pollinated trees of approximately 16 years of age are selected from plantation-grown sites, in the United States for loblolly pine, and in New Zealand for radiata pine. Trees are felled during the spring and summer seasons to compare the expression of genes associated with these different developmental stages of wood formation. Trees are felled individually and trunk sections are removed from the bottom area approximately one to two meters from the base and within one to two meters below the live crown. The section removed from the basal end of the trunk contains mature wood. The section removed from below the live crown contains juvenile wood. Samples collected during the spring season are termed earlywood or springwood, while samples collected during the summer season are considered latewood or summerwood (Larson et al., Gen. Tech. Rep. FPL-GTR-129. Madison, Wis.: U.S. Department of Agriculture, Forest Service, Forest Products Laboratory. p. 42).

Tissues are isolated from the trunk sections such that phloem, cambium, developing xylem, and maturing xylem are removed. These tissues are collected only from the current year's growth ring. Upon tissue removal in each case, the material is immediately plunged into liquid nitrogen to preserve the nucleic acids and other components. The bark is peeled from the section and phloem tissue removed from the inner face of the bark by scraping with a razor blade. Cambium tissue is isolated from the outer face of the peeled section by gentle scraping of the surface. Developing xylem and lignifying xylem are isolated by sequentially performing more vigorous scraping of the remaining tissue. Tissues are transferred from liquid nitrogen into containers for long term storage at −70 until RNA extraction and subsequent analysis is performed.

Example 22

This example illustrates a procedure for RNA extraction and purification, which is particularly useful for RNA obtained from conifer needle, xylem, cambium, and phloem.

Tissue is obtained from conifer needle, xylem, cambium or phloem. The tissue is frozen in liquid nitrogen and ground. The total RNA is extracted using Concert Plant RNA reagent (Invitrogen). The resulting RNA sample is extracted into phenol:chloroform and treated with DNase. The RNA is then incubated at 65° C. for 2 minutes followed by centrifugation at 4° C. for 30 minutes. Following centrifugation, the RNA is extracted into phenol at least 10 times to remove contaminants.

The RNA is further cleaned using RNeasy columns (Qiagen). The purified RNA is quantified using RiboGreen reagent (Molecular Probes) and purity assessed by gel electrophoresis.

RNA is then amplified using MessageAmp (Ambion). Aminoallyl-UTP and free UTP are added to the in vitro transcription of the purified RNA at a ratio of 4:1 aminoallyl-UTP-to-UTP. The aminoallyl-UTP is incorporated into the new RNA strand as it is transcribed. The amino-allyl group is then reacted with Cy dyes to attach the colorimetric label to the resulting amplified RNA using the Amersham procedure modified for use with RNA. Unincorporated dye is removed by ethanol precipitation. The labeled RNA is quantified spectrophotometrically (NanoDrop). The labeled RNA is fragmented by heating to 95° C. as described in Hughes et al., *Nature Biotechnol.* 19:342 (2001).

Example 23

This Example illustrates how genes important for wood development in *P. radiata* can be determined and how oligonucleotides which uniquely bind to those genes can be designed and synthesized for use on a microarray.

Pine trees of the species *P. radiata* are grown under natural light conditions. Tissue samples are prepared as described in, e.g., Sterky et al., *Proc. Nat'l Acad. Sci.* 95:13330 (1998). Specifically, tissue samples are collected from woody trees having a height of 5 meters. Tissue samples of the woody trees are prepared by taking tangential sections through the cambial region of the stem. The stems are sectioned horizontally into sections ranging from juvenile (top) to mature (bottom). The stem sections separated by stage of development are further separated into 5 layers by peeling into sections of phloem, differentiating phloem, cambium, differentiating xylem, developing xylem, and mature xylem. Tissue samples, including leaves, buds, shoots, and roots are also prepared from seedlings of the species *P. radiata*.

RNA is isolated and ESTs generated as described in the Example above or Sterky et al., supra. The nucleic acid sequences of ESTs derived from samples containing developing wood are compared with nucleic acid sequences of genes known to be involved in polysaccharide synthesis. ESTs from samples that do not contain developing wood are also compared with sequences of genes known to be involved in the plant cell cycle. An in silico hybridization analysis is performed using BLAST (NCBI) as follows.

Example 24

*Eucalyptus* in Silico Data

In silico gene expression can be used to determine the membership of the consensi EST libraries. For each library, a consensus is determined from the number of ESTs in any tissue class divided by the total number of ESTs in a class multiplied by 1000. These values provide a normalized value that is not biased by the extent of sequencing from a library. Several libraries were sampled for a consensus value, including reproductive, bud reproductive, bud vegetative, fruit, leaf, phloem, cambium, xylem, root, stem, sap vegetative, whole plant libraries.

As shown below, a number of the inventive sequences exhibit vascular-preferred expression (more than 50% of the hits by these sequences if the databases were searched at random would be in libraries made from developing vascular tissue) and thus are likely to be involved in wood-related developmental processes. The data are shown in Table 12.

Example 25

*Pinus* in Silico Data

In silico gene expression can be used to determine the membership of the consensi EST libraries. For each library, a consensus is determined from the number of ESTs in any tissue class divided by the total number of ESTs in a class multiplied by 1000. These values provide a normalized value that is not biased by the extent of sequencing from a library. Several libraries were sampled for a consensus value, including needles, phloem, cambium, xylem, root, stem and, whole plant libraries.

As shown below, a number of the inventive sequences exhibit vascular-preferred expression (more than 50% of the hits by these sequences if the databases were searched at random would be in libraries made from developing vascular tissue) and thus are likely to be involved in wood-related developmental processes. The data are shown in Table 13.

Example 26

Sequences that show hybridization in silico to ESTs made from samples containing developing wood, but that do not hybridize to ESTs from samples not containing developing wood are selected for further examination.

cDNA clones containing sequences that hybridize to the genes showing wood-preferred expression are selected from cDNA libraries using techniques well known in the art of molecular biology. Using the sequence information, oligonucleotides are designed such that each oligonucleotide is specific for only one cDNA sequence in the library. The oligonucleotide sequences are provided in Table 14. 60-mer oligonucleotide probes are designed using the method of Li and Stormo, supra or using software such as ArrayDesigner, GeneScan, and ProbeSelect.

The oligonucleotides are then synthesized in situ described in Hughes et al., *Nature Biotechnol.* 19:324 (2002) or as described in Kane et al., *Nucleic Acids Res.* 28:4552 (2000) and affixed to an activated glass slide (Sigma-Genosis, The Woodlands, Tex.) using a 5' amino linker. The position of each oligonucleotide on the slide is known.

Example 27

This example illustrates how to detect expression of *Pinus radiata* genes of the instant application which are important in wood formation using an oligonucleotide microarray prepared as described above. This is an example of a balanced incomplete block designed experiment carried out using aRNA samples prepared from mature-phase phloem (P), cambium (C), expanding xylem found in a layer below the cambium (X1) and differentiating, lignifying xylem cells found deeper in the same growth ring (X2). In this example, cell cycle gene expression is compared among the four samples, namely P, C, X1, and X2.

In the summer, plants of the species *Pinus radiata* are felled and the bark of the main stem is immediately pulled gently away to reveal the phloem and xylem. The phloem and xylem are then peeled with a scalpel into separate containers of liquid nitrogen. Needles (leaves) and buds from the trees are also harvested with a scalpel into separate containers of liquid nitrogen. RNA is subsequently isolated from the frozen tissue samples as described in Example 1. Equal microgram quantities of total RNA are purified from each sample using RNeasy Mini columns (Qiagen, Valencia, Calif.) according to the manufacturer's instructions.

Amplification reactions are carried out for each of the P, C, X1, and X2 tissue samples. Amplification reactions are performed using Ambion's MessageAmp kit, a T7-based amplification procedure, following the manufacturer's instructions, except that labeled aaUTP is added to the reagent mix during in the amplification step. aaUTP is incorporated into the resulting antisense RNA formed during this step. CyDye fluorescent labels are coupled to the aaUTPs in a non-enzymatic reaction as described in Example 1. Labeled amplified antisense RNAs are precipitated and washed, and then assayed for purity using a NanoDrop spectrophotometer. These labeled antisense RNAs, corresponding to the RNA isolated from the P, C, X1, and X2 tissue samples, constitute the sample nucleic acids, which are referred to as the P, C, X1, and X2 samples.

Normalization control samples of known nucleic acids are added to each sample in a dilution series of 500, 200, 100, 50, 25 and 10 pg/µl for quantitation of the signals. Positive controls corresponding to specific genes showing expression in all tissues of pine, such as housekeeping genes, are also added to the plant sample.

Each of four microarray slides is incubated with 125 µL of a P, C, X1 or X2 sample under a coverslip at 42° C. for 16-18 hours. The arrays are washed in 1×SSC, 0.1% SDS for 10 minutes and then in 0.1×SSC, 0.1% SDS for 10 minutes and the allowed to dry.

The array slides are scanned using an Axon laser scanner and analyzed using GenePix Pro software. Data from the microarray slides are subjected to microarray data analysis using GenStat SAS or Spotfire software. Outliers are removed and ratiometric data for each of the datasets are normalized using a global normalization which employs a cubic spline fit applied to correct for differential dye bias and spatial effects. A second transformation is performed to fit control signal ratios to a mean $\log^2=0$ (i.e. 1:1 ratio). Normalized data are then subjected to a variance analysis.

Mean signal intensity for each signal at any given position on the microarray slide is determined for each of three of P, C, X1, and X2 sample microarray slides. This mean signal/probe position is compared to the signal at the same position on sample slide which was not used for calculating the mean. For example, a mean signal at a given position is determined for P, C, and X1 and the signal at that position in the X2 microarray slide is compared to the P, C, and X1 mean signal value.

Table 5 shows genes having greater than doubled signal with any one sample as compared to the mean signal of the other three samples.

TABLE 5

| Gene | PvCX12 | PvX12 | CvX12 |
| --- | --- | --- | --- |
| WD40 repeat protein A | −1.24 | −0.88 | −1.07 |
| CDC2 | −1.09 | −0.78 | −0.92 |
| CYCLIN | −1.08 | −1 | −0.26 |
| WD-40 repeat protein B | −1.01 | −0.87 | −0.42 |
| CDC2 | −0.83 | −0.49 | −1.01 |

P = Phloem
C = Cambium
X1 = xylem layer-1
X2 = xylem layer-2
PvCX12 = Ratio of the signal for Phloem target versus mean signal for Cambium, Xylem1, and Xylem2 targets The data shows that WD40 repeat protein A encodes a WD40 repeat protein is less highly expressed in cambium than in developing xylem, while WD40 repeat protein B encodes a WD40 repeat protein that is more highly expressed in phloem than in the other tissues.

Signal data are then verified with RT-PCR to confirm gene expression in the target tissue of the genes corresponding to the unique oligonucleotides in the probe.

Example 28

This example illustrates how RNAs of tissues from multiple pine species, in this case both *P. radiata* and loblolly pine P. taeda trees, are selected for analysis of the pattern of gene expression associated with wood development in the juvenile wood and mature wood forming sections of the trees using the microarrays derived from P. radiata cDNA sequences described in Example 4.

Open pollinated trees of approximately 16 years of age are selected from plantation-grown sites, in the United States for loblolly pine, and in New Zealand for radiata pine. Trees are felled during the spring and summer seasons to compare the expression of genes associated with these different developmental stages of wood formation. Trees are felled individually and trunk sections are removed from the bottom area approximately one to two meters from the base and within one to two meters below the live crown. The section removed from the basal end of the trunk contains mature wood. The section removed from below the live crown contains juvenile wood. Samples collected during the spring season are termed earlywood or springwood, while samples collected during the summer season are considered latewood or summerwood. Larson et al., Gen. Tech. Rep. FPL-GTR-129. Madison, Wis.: U.S. Department of Agriculture, Forest Service, Forest Products Laboratory. p. 42.

Tissues are isolated from the trunk sections such that phloem, cambium, developing xylem, and maturing xylem are removed. These tissues are collected only from the current year's growth ring. Upon tissue removal in each case, the material is immediately plunged into liquid nitrogen to preserve the nucleic acids and other components. The bark is peeled from the section and pwloem tissue removed from the inner face of the bark by scraping with a razor blade. Cambium tissue is isolated from the outer face of the peeled section by gentle scraping of the surface. Developing xylem and lignifying xylem are isolated by sequentially performing more vigorous scraping of the remaining tissue. Tissues are transferred from liquid nitrogen into containers for long term storage at −70° C. until RNA extraction and subsequent analysis is performed.

Example 29

This example illustrates procedures alternative to those used in the example above for RNA extraction and purification, particularly useful for RNA obtained from a variety of tissues of woody plants, and a procedure for hybridization and data analysis using the arrays described in Example 4.

RNA is isolated according to the protocol of Chang et al., Plant Mol. Biol. Rep. 11:113. DNA is removed using DNase I (Invitrogen, Carlsbad, Calif.) according to the manufacturer's recommendations. The integrity of the RNA samples is determined using the Agilent 2100 Bioanalyzer (Agilent Technologies, USA).

10 μg of total RNA from each tissue is reverse transcribed into cDNA using known methods.

In the case of Pinus radiata phloem tissue, it can be difficult to extract sufficient amounts of total RNA for normal labelling procedures. Total RNA is extracted and treated as previously described and 100 ng of total RNA is amplified using the Ovation™ Nanosample RNA Amplification system from NuGEN™ (NuGEN, Calif., USA). Similar amplification kits such as those manufactured by Ambion may alternatively be used. The amplified RNA is reverse transcribed into cDNA and labelled as described above.

Hybridization and stringency washes are performed using the protocol as described in the US patent application for "Methods and Kits for Labeling and Hybridizing cDNA for Microarray Analysis" (supra) at 42 C. The arrays (slides) are scanned using a ScanArray 4000 Microarray Analysis System (GSI Lumonics, Ottawa, ON, Canada). Raw, non-normalized intensity values are generated using QUANTARRAY software (GSI Lumonics, Ottawa, ON, Canada).

A fully balanced, incomplete block experimental design (Kerr and Churchill, Gen. Res. 123:123, 2001) is used in order to design an array experiment that would allow maximum statistical inferences from analyzed data.

Gene expression data is analyzed using the SAS® Microarray Solution software package (The SAS Institute, Cary, N.C., USA). Resulting data was then visualized using JMP® (The SAS Institute, Cary, N.C., USA).

Analysis done for this experiment is an ANOVA approach with mixed model specification (Wolfinger et al., J. Comp. Biol. 8:625-637). Two steps of linear mixed models are applied. The first one, normalization model, is applied for global normalization at slide-level. The second one, gene model, is applied for doing rigorous statistical inference on each gene. Both models are stated in Models (1) and (2).

$$\log_2(Y_{ijkls}) = \theta_{ij} + D_k + S_l + DS_{kl} + \omega_{ijkls} \tag{1}$$

$$R_{ijkls}^{(g)} = \mu_{ij}^{(g)} + D_k^{(g)} + S_l^{(g)} + DS_{kl}^{(g)} + SS_{ls}^{(g)} + \epsilon_{ijkls}^{(g)} \tag{2}$$

$Y_{ijkls}$ represents the intensity of the $S^{th}$ spot in the $l^{th}$ slide with the $k^{th}$ dye applying the $j^{th}$ treatment for the $i^{th}$ cell line. $\theta_{ij}$, $D_k$, $S_l$, and $D_{Skl}$ represent the mean effect of the jth treatment in the ith cell line, the kth dye effect, the lth slide random effect, and the random interaction effect of the $k^{th}$ dye in the $l^{th}$ slide. $\omega_{ijkls}$ is the stochastic error term. represent the similar roles as $\theta_{ij}$, $D_k$, $S_l$, and $D_{Skl}$ except they are specific for the $g^{th}$ gene. $R_{ijkls}^{(g)}$ represents the residual of the $g^{th}$ gene from model (1). $\mu_{ij}^{(g)}$, $D_k^{(g)}$, $S_l^{(g)}$, and $DS_{kl}^{(g)}$ represent the similar roles as $\theta_{ij}$, $D_k$, $S_l$, and $DS_{kl}$ except they are specific for the $g^{th}$ gene. $SS_{ls}^{(g)}$ represent the spot by slide random effect for the $g^{th}$ gene. $\epsilon_{ijkls}^{(g)}$ represent the stochastic error term. All random terms are assumed to be normal distributed and mutually independent within each model.

According to the analysis described above, certain cDNAs, some of which are shown in Table 6 below, are found to be differentially expressed.

TABLE 6

| Gene corresponding to SEQ ID | Oligo ID | Gene_Family | Expression |
|---|---|---|---|
| 162 | Pra_000171_O_2 | Peptidylprolyl isomerase | steady state RNA higher in xylem than cambium |
| 164 | Pra_001480_O_3 | Peptidylprolyl isomerase | steady state RNA lower in xylem than cambium |
| control | Pra_000218_O_2 | RIBO-NUCLEOSIDE-DIPHOSPHATE REDUCTASE LARGE CHAIN (EC1.17.4.1). | steady state RNA lower in xylem than cambium |
| control | Pra_000193_O_2 | PUTATIVE SURFACE PROTEIN. | steady state RNA lower in xylem than cambium |

The involvement of these specific genes in wood development is inferred through the association of the up-regulation or down-regulation of genes to the particular stages of wood development. Both the spatial continuum of wood development across a section (phloem, cambium, developing xylem, maturing xylem) at a particular season and tree trunk position and the relationships of season and tree trunk position are considered when making associations of gene expression to the relevance in wood development.

Example 30

This example demonstrates how one can correlate polysaccharide gene expression with agronomically important wood phenotypes such as density, stiffness, strength, distance between branches, and spiral grain.

Mature clonally propagated pine trees are selected from among the progeny of known parent trees for superior growth characteristics and resistance to important fuingal diseases. The bark is removed from a tangential section and the trees are examined for average wood density in the fifth annual ring at breast height, stiffness and strength of the wood, and spiral grain. The trees are also characterized by their height, mean distance between major branches, crown size, and forking.

To obtain seedling families that are segregating for major genes that affect density, stiffness, strength, distance between branches, spiral grain and other characteristics that may be linked to any of the genes affecting these characteristics, trees lacking common parents are chosen for specific crosses on the criterion that they exhibit the widest variation from each other with respect to the density, stiffness, strength, distance between branches, and spiral grain criteria. Thus, pollen from a tree exhibiting high density, low mean distance between major branches, and high spiral grain is used to pollinate cones from the unrelated plus tree among the selections exhibiting the lowest density, highest mean distance between major branches, and lowest spiral grain. It is useful to note that "plus trees" are crossed such that pollen from a plus tree exhibiting high density are used to pollinate developing cones from another plus tree exhibiting high density, for example, and pollen from a tree exhibiting low mean distance between major branches would be used to pollinate developing cones from another plus tree exhibiting low mean distance between major branches.

Seeds are collected from these controlled pollinations and grown such that the parental identity is maintained for each seed and used for vegetative propagation such that each genotype is represented by multiple ramets. Vegetative propagation is accomplished using micropropagation, hedging, or fascicle cuttings. Some ramets of each genotype are stored while vegetative propagules of each genotype are grown to sufficient size for establishment of a field planting. The genotypes are arrayed in a replicated design and grown under field conditions where the daily temperature and rainfall are measured and recorded.

The trees are measured at various ages to determine the expression and segregation of density, stiffness, strength, distance between branches, spiral grain, and any other observable characteristics that may be linked to any of the genes affecting these characteristics. Samples are harvested for characterization of cellulose content, lignin content, cellulose microfibril angle, density, strength, stiffness, tracheid morphology, ring width, and the like. RNA is then collected from replicated samples of trees showing divergent stiffness and density, or other characteristics, from genotypes that are otherwise as similar as possible in growth habit, in spring and fall so that early and late wood development is assayed. These samples are examined for gene expression similarly as described in above examples.

TABLE 7

Concensus ID Information.

| Patent app | SEQ ID | Gene Family | Consensus_ID | Expression |
|---|---|---|---|---|
| — | control | Ribonucleoside-diphosphate reductase | pinusRadiata_000218 | up in early spring xylem vs late summer xylem |
| Cell Cycle | 168 | Peptidylprolyl isomerase | pinusRadiata_001692 | up in juvenile developing wood vs mature developing xylem |
| — | control | Nitrite transporter | pinusRadiata_016801 | up mature developing xylem vs juvenile cambium |

Ramets of each genotype are compared to ramets of the same genotype at different ages to establish age:age correlations for these characteristics.

Example 31

Example 8 demonstrates how responses to environmental conditions such as light and season alter plant phenotype and can be correlated to polysaccharide synthesis gene expression using microarrays. In particular, the changes in gene expression associated with wood density are examined.

Trees of three different clonally propagated *E. grandis* hybrid genotypes are grown on a site with a weather station that measures daily temperatures and rainfall. During the spring and subsequent summer, genetically identical ramets of the three different genotypes are first photographed with north-south orientation marks, using photography at sufficient resolution to show bark characteristics of juvenile and mature portions of the plant, and then felled. The age of the trees is determined by planting records and confirmed by a count of the annual rings. In each of these trees, mature wood is defined as the outermost rings of the tree below breast height, and juvenile wood as the innermost rings of the tree above breast height. Each tree is accordingly sectored as follows:

NM—NORTHSIDE MATURE
SM—SOUTHSIDE MATURE
NT—NORTHSIDE TRANSITION
ST—SOUTHSIDE TRANSITION
NJ—NORTHSIDE JUVENILE
SJ—SOUTHSIDE JUVENILE

Tissue is harvested from the plant trunk as well as from juvenile and mature form leaves. Samples are prepared simultaneously for phenotype analysis, including plant morphology and biochemical characteristics, and gene expression analysis. The height and diameter of the tree at the point from which each sector was taken is recorded, and a soil sample from the base of the tree is taken for chemical assay. Samples prepared for gene expression analysis are weighed and placed into liquid nitrogen for subsequent preparation of RNA samples for use in the microarray experiment. The tissues are denoted as follows:

P—phloem
C—cambium
X1—expanding xylem
X2—differentiating and lignifying xylem

Thin slices in tangential and radial sections from each of the sectors of the trunk are fixed as described in Ruzin, PLANT MICROTECHNIQUE AND MICROSCOPY, Oxford University Press, Inc., New York, N.Y. (1999) for anatomical examination and confirmation of wood developmental stage. Microfibril angle is examined at the different developmental stages of the wood, for example juvenile, transition and mature phases of *Eucalyptus grandis* wood. Other characteristics examined are the ratio of fibers to vessel elements and ray tissue in each sector. Additionally, the samples are examined for characteristics that change between juvenile and mature wood and between spring wood and summer wood, such as fiber morphology, lumen size, and width of the S2 (thickest) cell wall layer. Samples are further examined for measurements of density in the fifth ring and determination of modulus of elasticity using techniques well known to those skilled in the art of wood assays. See, e.g., Wang, et al., *Non-destructive Evaluations of Trees*, EXPERIMENTAL TECHNIQUES, pp. 28-30 (2000).

For biochemical analysis, 50 grams from each of the harvest samples are freeze-dried and analyzed, using biochemical assays well known to those skilled in the art of plant biochemistry for quantities of simple sugars, amino acids, lipids, other extractives, lignin, and cellulose. See, e.g., Pettersen & Schwandt, *J. Wood Chem. & Technol.* 11:495 (1991).

In the present example, the phenotypes chosen for comparison are high density wood, average density wood, and low density wood. Nucleic acid samples are prepared as described in Example 3, from trees harvested in the spring and summer. Gene expression profiling by hybridization and data analysis is performed as described above.

Using similar techniques and clonally propagated individuals one can examine polysaccharide gene expression as it is related to other complex wood characteristics such as strength, stiffness and spirality.

Example 32

Example 32 demonstrates the use of a vascular-preferred promoter functionally linked to one of the genes of the instant application.

A vascular-preferred promoter is then linked to one of the genes in the instant application and used to transform tree species. Boosted transcript levels of the candidate gene in the xylem of the transformants results in an increased xylem biomass phenotype.

In another example, a vascular-preferred promoter such as any of those in ArborGen's November 2003 patent applications is then linked to an RNAi construct containing sequences from one of the genes in the instant application and used to transform a tree of the genus from which the gene was isolated. Reduced transcript levels of the candidate gene in the xylem of the transformants results in an increased xylem biomass phenotype.

Example 33

The vector pARB476 was developed using the following steps. The Bluescript vector (Stratagene, La Jolla, Calif.) was modified by adding the Superubiquitin 3'UTR and nos 3'terminator sequence at the KpnI and ClaI sites to produce the vector pARB005 (SEQ ID NO. 773). To this vector the *P. radiata* superubiquitin promoter with intron was added. The promoter/intron sequence was first amplified from the *P. radiata* superubiquitin sequence identifed in U.S. Pat. No. 6,380,459 using standard PCR techniques and the primers of SEQ ID NOS 774 and 775. The amplified fragment was then ligated into pARB005 using XbaI and PstI restriction digestion to produce the vector pARB119 (SEQ ID NO. 776).

The *poplus tremuloises* UDB Glucose binding domain gene (patent WO OO71670, ptCelA Genbank number AF07213 1) was amplified using standard PCR techniques and primers including and ATG and a ClaI site as part of the 5' primer and a TGA and a ClaI site as part of the 3' primer. The amplified fragment was then cloned into the ClaI site of pARB119 to produce the vector pARB476 (SEQ ID NO. 777).

The NotI cassette containing the *P. radiata* superubiquitin promoter with intron::UDP Glucose Binding domain:: 3'UTR: nos terminator from pARB476 was removed and cloned into the NotI site of pART29 to produce the vector pARB483. The binary vector pART29 is a modified pART27 vector (Gleave, *Plant Mol. Biol.* 20:1203-1207, 1992) that contains the Arabidopsis thaliana ubiquitin 3 (UBQ3) promoter instead of the nos5' promoter and no lacZ sequences.

SEQ ID 773

```
CGATGGGTGTTATTTGTGGATAATAAATTCGGGTGATGTTCAGTGTTTGTCGTATTTCTCACGAATAAA

TTGTGTTTATGTATGTGTTAGTGTTGTTTGTCTGTTTCAGACCCTCTTATGTTATATTTTTCTTTTCGT

CGGTCAGTTGAAGCCAATACTGGTGTCCTGGCCGGCACTGCAATACCATTTCGTTTAATATAAAGACTC

TGTTATCCGTGAGCTCGAATTTCCCCGATCGTTCAAACATTTGGCAATAAAGTTTCTTAAGATTGAATC

CTGTTGCCGGTCTTGCGATGATTATCATATAATTTCTGTTGAATTACGTTAAGCATGTAATAATTAACA

TGTAATGCATGACGTTATTTATGAGATGGGTTTTTATGATTAGAGTCCCGCAATTATACATTTAATACG

CGATAGAAAACAAAATATAGCGCGCAAACTAGGATAAATTATCGCGCGCGGTGTCATCTATGTTACTAG

ATCGCGGCCGCATTTAAATGGTACCCAATTCGCCCTATAGTGAGTCGTATTACGCGCGCTCACTGGCCG

TCGTTTTACAACGTCGTGACTGGGAAAACCCTGGCGTTACCCAACTTAATCGCCTTGCAGCACATCCCC

CTTTCGCCAGCTGGCGTAATAGCGAAGAGGCCGGCACCCATCGCCCTTCCCAACAGTTGCGCAGCCTGA

ATGGCGAATGGGACGCGCCCTGTAGCGGCGCATTAAGCGCGGCGGGTGTGGTGGTTACGCGCAGCGTGA
```

-continued

```
CCGCTACACTTGCCAGCGCCCTAGCGCCCGCTCGTTTCGCTTTCTTCCCTTCCTTTCTCGCCACGTTCG
CCGGCTTTCCCCGTCAAGCTCTAAATCGGGGGCTCCCTTTAGGGTTCCGATTTAGTGCTTTACGGCACC
TGGACCCCAAAAAACTTGATTAGGGTGATGGTTCACGTAGTGGGCCATCGCCCTGATAGACGGTTTTTC
GCCCTTTGACGTTGGAGTCCACGTTCTTTAATAGTGGACTCTTGTTGCAAACTGGAACAACACTCAACC
CTATCTCGGTCTATTCTTTTGATTTATAAGGGATTTTGCCGATTTCGGCCTATTGGTTAAAAAATGAGC
TGATTTAACAAAAATTTAACGCGAATTTTAACAAAATATTAACGCTTACAATTTAGGTGGCACTTTTCG
GGGAAATGTGCGCGGAACCCCTATTTGTTTATTTTTCTAAATACATTCAAATATGTATCCGCTCATGAG
ACAATAACCCTGATAAATGCTTCAATAATATTGAAAAAGGAAGAGTATGAGTATTCAACATTTCCGTGT
CGCCCTTATTCCCTTTTTTGCGGCATTTTGCCTTCCTGTTTTTGCTCACCCAGAAACGCTGGTGAAAGT
AAAAGATGCTGAAGATCAGTTGGGTGCACGAGTGGGTTACATCGAACTGGATCTCAACAGCGGTAAGAT
CCTTGAGAGTTTTCGCCCCGAAGAACGTTTTCCAATGATGAGCACTTTTAAAGTTCTGCTATGTGGCGC
GGTATTATCCCGTATTGACGCCGGGCAAGAGCAACTCGGTCGCCGCATACACTATTCTCAGAATGACTT
GGTTGAGTACTCACCAGTCACAGAAAAGCATCTTACGGATGGCATGACAGTAAGAGAATTATGCAGTGC
TGCCATAACCATGAGTGATAACACTGCGGCCAACTTAGTTCTGACAACGATCGGAGGACCGAAGGAGCT
AACCGCTTTTTTGCACAACATGGGGGATCATGTAACTCGCCTTGATCGTTGGGAACCGGAGCTGAATGA
AGCCATACGAAACGACGAGCGTGACACCACGATGCCTGTAGCAATGGCAACAACGTTGCGCAAACTATT
AACTGGGGAACTACTTACTCTAGCTTCCCGGCAAGAATTAATAGACTGGATGGAGGCGGATAAAGTTGC
AGGACCACTTCTGCGCTCGGCCCTTCCGGCTGGCTGGTTTATTGGTGATAAATCTGGAGCCGGTGAGCG
TGGGTCTCGCGGTATCATTGCAGCACTGGGGCCAGATGGTAAGCCCTCCCGTATCGTAGTTATCTACAC
GACGGGGAGTCAGGCAACTATGGATGAACGAAATAGACAGATCGCTGAGATAGGTGCCTCACTGATTAA
GCATTGGTAACTGTCAGACCAAGTTTACTCATATATACTTTAGATTGATTTAAAACTTCATTTTTAATT
TAAAAGGATCTAGGTGAAGATCCTTTTTGATAATCTCATGACCAAAATCCCTTAACGTGAGTTTTCGTT
CCACTGAGCGTCAGACCCCGTAGAAAAGATCAAAGGATCTTCTTGAGATCCTTTTTTTCTGCGCGTAAT
CTGCTGCTTGCAAACAAAAAAACCACCGCTACCAGCGGTGGTTTGTTTGCCGGATCAAGAGCTACCAAC
TCTTTTTCCGAAGGTAACTGGCTTCAGCAGAGCGCAGATACCAAATACTGTCCTTCTAGTGTAGCCGTA
GTTAGGCCACCACTTCAAGAACTCTGTAGCACCGCCTACATACCTCGCTCTGCTAATCCTGTTACCAGT
GGCTGCTGCCAGTGGCGATAAGTGGTGTCTTACCGGGTTGGAGTCAAGACGATAGTTACCGGATAAGGC
GCAGCGGTCGGGCTGAACGGGGGGTTCGTGCACACAGCCCAGGTTGGAGCGAACGAGCTACACCGAACT
GAGATAGCTACAGCGTGAGCTATGAGAAAGCGCCACGCTTCCCGAAGGGAGAAAGGCGGACAGGTATCC
GGTAAGCGGCAGGGTCGGAACAGGAGAGCGCACGAGGGAGCTTCCAGGGGGAAACGCCTGGTATGTTTA
TAGTCCTGTCGGGTTTCGCCACCTCTGACTTGAGCGTCGATTTTTGTGATGCTCGTCAGGGGGCGGAG
CCTATGGAAAAACGCCAGCAAGGCGGCCTTTTTACGGTTCCTGGCCTTTTGCTGGCCTTTTGCTCACAT
GTTCTTTCGTGCGTTATCCCCTGATTCTGTGGATAACCGTATTACCGCCTTTGAGTGAGCTGATACCGC
TCGCCGCAGCCGAACGAGCGAGCGGAGGGAGTCAGTGAGCGAGGAAGCGGAAGAGCGCCCAATACGCAA
ACGGCCTCTCCGCGCGCGTTGGCCGATTCATTAATGCAGCTGGCACGACAGGTTTCCCGACTGGAAAGC
GGGCAGTGAGCGCAACGCAATTAATGTGAGTTAGCTCACTCATTAGGCACCCCAGGCTTTACACTTTAT
GCTTCCGGCTCGTATGTTGTGTGGAATTGTGAGCGGATAACAATTTCACACAGGAAACAGGTATGACCA
TGATTACGCCAAGCGCGCAATTAACCCTCACTAAAGGGAACAAAAGCTGGGGCCGCTCTAGAACTAGTG
GATCCCCCGGGCTGCAGGAATTCGTCCAGCAGTTGTCTGGAGCTCCACCAGAAATCTGGAAGCTTAT
```

-continued

SEQ ID 774
AAATCTAGAGGTACCATTTAAATGCGGCCGCAAAACCCCTCACAAATACATAA

SEQ ID 775
TTTCTGCAGCTTGAAATTGAAATATGACTAACGAAT

SEQ ID 776
tctagaggtaccatttaaatgcggccgcaaaacccctcacaaatacataaaaaaaattctttatttaat
tatcaaactctccactacctttcccaccaaccgttacaatcctgaatgttggaaaaaactaactacatt
gatataaaaaaactacattacttcctaaatcatatcaaaattgtataaatatatccactcaaaggagtc
tagaagatccacttggacaaattgcccatagttggaaagatgttcaccaagtcaacaagatttatcaat
ggaaaaatccatctaccaaacttactttcaagaaaatccaaggattatagagtaaaaaatctatgtatt
attaagtcaaaaagaaaaccaaagtgaacaaatattgatgtataagtttgagaggataagacattggaa
tcgtctaaccaggaggcggaggaattccctagacagttaaaagtggccggaatcccggtaaaaagatt
aaaatttttttgtagagggagtgcttgaatcatgttttttatgatggaaatagattcagcaccatcaaa
aacattcaggacacctaaaattttgaagtttaacaaaaataacttggatctacaaaaatccgtatcgga
ttttctctaaatataactagaattttcataactttcaaagcaactcctcccctaaccgtaaaacttttc
ctacttcaccgttaattacattccttaagagtagataaagaaataaagtaaataaaagtattcacaaac
caacaatttatttcttttatttacttaaaaaaacaaaaagtttatttatttttacttaaatggcataatg
acatatcggagatccctcgaacgagaatcttttatctccctggttttgtattaaaaagtaatttattgt
ggggtccacgcggagttggaatcctacagacgcgctttacatacgtctcgagaagcgtgacggatgtgc
gaccggatgaccctgtataacccaccgacacagccagcgcacagtatacacgtgtcatttctctattgg
aaaatgtcgttgttatccccgctggtacgcaaccaccgatggtgacaggtcgtctgttgtcgtgtcgcg
tagcgggagaagggtctcatccaacgctattaaatactcgccttcaccgcgttacttctcatcttttct
cttgcgttgtataatcagtgcgatattctcagagagcttttcattcaaaggtatggagttttgaagggc
tttactcttaacatttgttttctttgtaaattgttaatggtggtttctgtggggaagaatcttttgc
caggtccttttgggtttcgcatgtttatttgggttattttctcgactatggctgacattactagggct
ttcgtgctttcatctgtgttttcttcccttaataggtctgtctctctggaatatttaattttcgtatgt
aagttatgagtagtcgctgtttgtaataggctcttgtctgtaaaggtttcagcaggtgtttgcgtttta
ttgcgtcatgtgtttcagaaggcctttgcagattattgcgttgtacttaatattttgtctccaacctt
gttatagtttccctcctttgatctcacaggaacccttttcttctttgagcattttcttgtggcgttctgt
agtaatattttaattttgggcccgggttctgagggtaggtgattattcacagtgatgtgctttccctat
aaggtcctctatgtgtaagctgttagggtttgtgcgttactattgacatgtcacatgtcacatattttc
ttcctcttatccttcgaactgatggttctttttctaattcgtggattgctggtgccatattttatttct
attgcaactgtatttagggtgtctctttcttttttgatttcttgttaatatttgtgttcaggttgtaac
tatgggttgctagggtgtctgccctcttcttttgtgcttcttcgcagaatctgtccgttggtctgtat
ttgggtgatgaattatttattccttgaagtatctgtctaattagcttgtgatgatgtgcaggtatattc
gttagtcatatttcaatttcaagcgatccccggctgcaggaattcgtccagcagttgtctggagctc
caccagaaatctggaagcttatcgatgggtgttatttgtggataataaattcgggtgatgttcagtgtt
tgtcgtatttctcacgaataaattgtgtttatgtatgtgttagtgttgtttgtctgtttcagaccctct
tatgttatattttctttttcgtcggtcagttgaagccaatactggtgtcctggccggcactgcaatacc
atttcgtttaatataaagactctgttatccgtgagctcgaatttccccgatcgttcaaacatttggcaa
taaagtttcttaagattgaatcctgttgccggtcttgcgatgattatcatataatttctgttgaattac -continued

```
gttaagcatgtaataattaacatgtaatgcatgacgttatttatgagatgggttttttatgattagagtc ccgcaattatacatttaatacgcgatagaaaacaaaatatagcgcgcaaactaggataaaattatcgcgc gcggtgtcatctatgttactagatcgcggccgcatttaaatggtacccaattcgccctatagtgagtcg tattacgcgcgctcactggccgtcgttttacaacgtcgtgactgggaaaaccctggcgttacccaactt aatcgccttgcagcacatccccctttcgccagctggcgtaatagcgaagaggcccgcaccgatcgccct tcccaacagttgcgcagcctgaatggcgaatgggacgcgccctgtagcggcgcattaagcgcggcgggt gtggtggttacgcgcagcgtgaccgctacacttgccagcgccctagcgcccgctcctttcgctttcttc ccttcctttctcgccacgttcgccggctttccccgtcaagctctaaatcgggggctccctttagggttc cgatttagtgctttacggcacctcgaccccaaaaaacttgattagggtgatggttcacgtagtgggcca tcgcccgatagacggttttccgcccttgacgttggagtccacgttctttaatagtggactcttgttc caaactggaacaacactcaaccctatctcggtctattcttttgatttataagggatttgccgatttcg gcctattggttaaaaaatgagctgatttaacaaaaatttaacgcgaattttaacaaaatattaacgctt acaatttaggtggcacttttcggggaaatgtgcgcggaaccccatttgtttatttttctaaatacatt caaatatgtatccgctcatgagacaataaccctgataaatgcttcaataatattgaaaaaggaagagta tgagtattcaacatttccgtgtcgcccttattccctttttgcggcattttgccttcctgtttttgctc acccagaaacgctggtgaaagtaaaagatgctgaagatcagttgggtgcacgagtgggttacatcgaac tggatctcaacagcggtaagatccttgagagttttcgccccgaagaacgttttccaatgatgagcactt ttaaagttctgctatgtggcgcggtattatcccgtattgacgccgggcaagagcaactcggtcgccgca tacactattctcagaatgacttggttgagtactcaccagtcacagaaaagcatcttacgatggcatga cagtaagagaattatgcagtgctgccataaccatgagtgataacactgcggccaacttacttctgacaa cgatcggaggaccgaaggagctaaccgcttttttgcacaacatggggatcatgtaactcgccttgatc gttgggaaccggagctgaatgaagccataccaaacgacgagcgtgacaccacgatgcctgtagcaatgg caacaacgttgcgcaaactattaactggcgaactacttactctagcttcccggcaacaattaatagact ggatggaggcggataaagttgcaggaccacttctgcgctcggcccttccggctggctggtttattgctg ataaatctggagccggtgagcgtgggtctcgcggtatcattgcagcactggggccagatggtaagccct cccgtatcgtagttatctacacgacggggagtcaggcaactatggatgaacgaaatagacagatcgctg agataggtgcctcactgattaagcattggtaactgtcagaccaagtttactcatatatactttagattg atttaaaacttcattttaatttaaaaggatctaggtgaagatcctttttgataatctcatgaccaaaa tcccttaacgtgagttttcgttccactgagcgtcagaccccgtagaaaagatcaaaggatcttcttgag atcctttttttctgcgcgtaatctgctgcttgcaaacaaaaaaaccaccgctaccagcggtggtttgtt tgccggatcaagagctaccaactctttttccgaaggtaactggcttcagcagagcgcagataccaaata ctgtccttctagtgtagccgtagttaggccaccacttcaagaactctgtagcaccgcctacatacctcg ctctgctaatcctgttaccagtggctgctgccagtggcgataagtcgtgtcttaccgggttggactcaa gacgatagttaccggataaggcgcagcggtcgggctgaacggggggttcgtgcacacagcccagcttgg agcgaacgacctacaccgaactgagatacctacagcgtgagctatgagaaagcgccacgcttcccgaag ggagaaaggcggacaggtatccggtaagcggcagggtcggaacaggagagcgcacgagggagcttccag ggggaaacgcctggtatctttatagtcctgtcgggtttcgccacctctgacttgagcgtcgatttttgt gatgctcgtcaggggggcggagcctatggaaaaacgccagcaacgcggcctttttacggttcctggcct tttgctggccttttgctcacatgttctttcctgcgttatcccctgattctgtggataaccgtattaccg cctttgagtgagctgataccgctcgccgcagccgaacgaccgagcgcagcgagtcagtgagcgaggaag
```

-continued cggaagagcgcccaatacgcaaaccgcctctccccgcgcgttggccgattcattaatgcagctggcacg acaggtttcccgactggaaagcgggcagtgagcgcaacgcaattaatgtgagttagctcactcattagg caccccaggctttacactttatgcttccggctcgtatgttgtgtggaattgtgagcggataacaatttc acacaggaaacagctatgaccatgattacgccaagcgcgcaattaaccctcactaaagggaacaaaagc tggggccgctctag

SEQ ID 777

TCTAGAGGTACCATTTAAATGCGGCCGCAAAACCCCTCACAAATACATAAAAAAAATTCTTTATTTAAT

TATCAAACTCTCCACTACCTTTCCCACCAACCGTTACAATCCTGAATGTTGGAAAAAACTAACTACATT

GATATAAAAAAACTACATTACTTCCTAAATCATATCAAAATTGTATAAATATATCCACTCAAAGGAGTC

TAGAAGATCCACTTGGACAAATTGCCCATAGTTGGAAAGATGTTCACCAAGTCAACAAGATTTATCAAT

GGAAAAATCCATCTAGCAAACTTACTTTCAAGAAAATCCAAGGATTATAGAGTAAAAAATCTATGTATT

ATTAAGTCAAAAGAAAACCAAAGTGAACAAATATTGATGTACAAGTTTGAGAGGATAAGACATTGGAA

TCGTCTAACCAGGAGGGGGAGGAATTCCCTAGACAGTTAAAAGTGGCCGGAATCCCGGTAAAAAGATT

AAAATTTTTTGTAGAGGGAGTGCTTGAATCATGTTTTTATGATGGAAATAGATTCAGCACCATCAAA

AACATTCAGGACACCTAAAATTTTGAAGTTTAACAAAAATAACTTGGATCTACAAAAATCCGTATCGGA

TTTTCTCTAAATATAACTAGAATTTTCATAACTTTCAAAGCAACTCCTGCCCTAACCGTAAAACTTTTC

CTACTTCACCGTTAATTACATTCCTTAAGAGTAGATAAAGAAATAAAGTAAATAAAAGTATTCACAAAC

CAACAATTTATTTCTTTTATTTACTTAAAAAAACAAAAAGTTTATTTATTTTACTTAAATGGCATAATG

ACATATCGGAGATCCCTCGAACGAGAATCTTTTATCTCCCTGGTTTTGTATTAAAAAGTAATTTATTGT

GGGGTGGACGCGGAGTTGGAATCCTACAGACGGGCTTTACATACGTCTGGAGAAGGGTGACGGATGTGC

GACCGGATGACCGTGTATAACCCACCGACACAGCCAGCGCACAGTATACACGTGTGATTTCTCTATTGG

AAAATGTCGTTGTTATCCCCGCTGGTACGCAACCACCGATGGTGACAGGTCGTCTGTTGTCGTGTCGCG

TAGCGGGAGAAGGGTCTCATCCAACGCTATTAAATACTCGCCTTCACCGCGTTACTTCTCATCTTTTCT

CTTGCGTTGTATAATCAGTGCGATATTCTCAGAGAGCTTTTCATTCAAAGGTATGGAGTTTTGAAGGGC

TTTACTCTTAACATTTGTTTTTCTTTGTAAATTGTTAATGGTGGTTTCTGTGGGGGAAGAATCTTTTGC

CAGGTCCTTTTGGGTTTCGCATGTTTATTTGGGTTATTTTTCTCGACTATGGCTGACATTACTAGGGCT

TTCGTGCTTTGATCTGTGTTTTCTTCCCTTAATAGGTCTGTCTCTCTGGAATATTTAATTTTCGTATGT

AAGTTATGAGTAGTCGCTGTTTGTAATAGGCTCTTGTCTGTAAAGGTTTCAGCAGGTGTTTGCGTTTTA

TTGCGTCATGTGTTTCAGAAGGCGTTTGCAGATTATTGCGTTGTACTTTAATATTTTGTCTCCAACCTT

GTTATAGTTTCCCTCCTTTGATCTCACAGGAACCCTTTCTTCTTTGAGCATTTTCTTGTGGCGTTCTGT

AGTAATATTTTAATTTTGGGCCCGGGTTCTGAGGGTAGGTGATTATTCACAGTGATGTGCTTTCCCTAT

AAGGTCCTCTATGTGTAAGGTGTTAGGGTTTGTGCGTTACTATTGACATGTCACATGTCACATATTTTC

TTCCTCTTATCCTTCGAACTGATGGTTCTTTTTCTAATTCGTGGATTGGTGGTGCCATATTTTATTTCT

ATTGCAAGTGTATTTTAGGGTGTCTCTTTCTTTTTGATTTCTTGTTAATATTTGTGTTCAGGTTGTAAC

TATGGGTTGCTAGGGTGTCTGCCCTCTTGTTTTGTGCTTCTTTCGCAGAATCTGTCCGTTGGTCTGTAT

TTGGGTGATGAATTATTTATTCCTTGAAGTATCTGTCTAATTAGCTTGTGATGATGTGCAGGTATATTC

GTTAGTCATATTTCAATTTCAAGGGATCCCCCGGGCTGCAGGAATTCGTCCAGCAGTTGTCTGGAGCTC

CACCAGAAATCTGGAAGCTTATCGATATGGATCAGTTCCCCAAGTGGAATCCTGTCAATAGAGAAACGT

ATATCGAAAGGCTGTCGGCAAGGTATGAAAGAGAGGGTGAGCCTTCTCAGCTTGCTGGTGTGGATTTTT

TCGTGAGTACTGTTGATCCGCTGAAGGAACCGCCATTGATCACTGCCAATACAGTCCTTTCGATCCTTG

CTGTGGACTATCCCGTCGATAAAGTCTCCTGCTACGTGTGTGATGATGGTGCAGCTATGCTTTCATTTG

-continued

```
AATCTCTTGTAGAAACAGCTGAGTTTGCAAGGAAGTGGGTTCCGTTCTGCAAAAAATTGTCAATTGAAG

GAAGAGCACCGGAGTTTTACTTCTCACAGAAAATTGATTACTTGAAAGAGAAGGTTCAACCTTCTTTCG

TGAAAGAACGTAGAGCAATGAAAAGGGATTATGAAGAGTACAAAGTCCGAGTTAATGCCCTGGTAGCAA

AGGCTCAGAAAACACCTGAAGAAGGATGGAGTATGCAAGATGGAACACCTTGGCCTGGGAATAACACAC

GTGATCACCCTGGCATGATTCAGGTCTTCCTTGGAAATACTGGAGCTCGTGACATTGAAGGAAATGAAC

TACCTCGTCTAGTATATGTCTCCAGGGAGAAGAGACCTGGCTACCAGCACCACAAAAAGGCTGGTGCAG

AAAATGCTCTGGTGAGAGTGTCTGCAGTACTCACAAATGCTCCCTACATCCTCAATGTTGATTGTGATC

ACTATGTAAACAATAGCAAGGCTGTTCGAGAGGCAATGTGCATCCTGATGGACCCACAAGTAGGTCGAG

ATGTATGCTATGTGCAGTTGCCTCAGAGGTTTGATGGCATAGATAAGAGTGATCGCTACGCCAATCGTA

ACGTAGTTTTCTTTGATGTTAACATGAAAGGGTTGGATGGCATTCAAGGACCAGTATACGTAGGAACTG

GTTGTGTTTTCAACAGGCAAGCACTTTACGGCTACGGGCCTCCTTCTATGCCCAGCTTACGCAAGAGAA

AGGATTCTTCATCCTGCTTCTCATGTTGCTGCCCCTCAAAGAAGAAGCCTGCTCAAGATCCAGCTGAGG

TATACAGAGATGCAAAAGAGAGGATCTCAATGCTGCCATATTTAATCTTACAGAGATTGATAATTATG

ACGAGGATGAAAGGTCAATGCTGATCTCGCAGTTGAGCTTTGAGAAAACTTTTGGCTTATCTTCTGTCT

TCATTGAGTCTACACTAATGGAGAATGGAGGAGTACCCGAGTCTGCCAACTCACGAACACTCATCAAGG

AAGCAATTCATGTCATCGGCTGTGGCTATGAAGAGAAGACTGAATGGGGAAAAGAGATTGGTTGGATAT

ATGGGTCAGTCACTGAGGATATCTTAAGTGGCTTCAAGATGCACTGCCGAGGATGGAGATCAATTTACT

GCATGCCCGTAAGGCCTGCATTCAAAGGATCTGCACCCATCAACCTGTCTGATAGATTGCACCAGGTCC

TCCGATGGGCTCTTGGTTCTGTGGAAATTTTCTTTAGCAGACACTGTCCCCTCTGGTACGGGTTTGGAG

GAGGCCGTGTTAAATGGCTCCAAAGGCTTGCGTATATAAACACCATTGTGTACCCATGAATCGATGGGT

GTTATTTGTGGATAATAAATTCGGGTGATGTTCAGTGTTTGTCGTATTTCTCACGAATAAATTGTGTTT

ATGTATGTGTTAGTGTTGTTTGTCTGTTTCAGACCCTCTTATGTTATATTTTTCTTTTCGTCGGTCAGT

TGAAGCCAATACTGGTGTCCTGGCCGGCACTGCAATACCATTTGGTTTAATATAAAGACTCTGTTATCC

GTGAGCTCGAATTTCCCCGATCGTTCAAACATTTGGCAATAAAGTTTCTTAAGATTGAATCCTGTTGCC

GGTCTTGCGATGATTATCATATAATTTCTGTTGAATTACGTTAAGCATGTAATAATTAACATGTAATGC

ATGAGGTTATTTATGAGATGGGTTTTTATGATTAGAGTCCCGCAATTATACATTTAATACGCGATAGAA

AAGAAAATATAGCGCGCAAACTAGGATAAATTATCGCGCGCGGTGTCATCTATGTTACTAGATCGCGGC

CGCATTTAAATGGTACCCAATTCGCCCTATAGTGAGTCGTATTACGCGCGCTCACTGGCCGTCGTTTTA

CAACGTCGTGACTGGGAAAACCCTGGCGTTACCCAACTTAATCGCCTTGCAGCACATCCCGCTTTCGCC

AGCTGGCGTAATAGCGAAGAGGCCCGCACCGATCGCCCTTGCCAACAGTTGCGCAGCCTGAATGGCGAA

TGGGACGCGCCCTGTAGCGGCGCATTAAGCGCGGCGGGTGTGGTGGTTACGCGCAGCGTGACCGCTACA

CTTGCCAGCGCCCTAGCGCCCGCTCCTTTGGCTTTCTTCGGTTCCTTTCTCGCCACGTTCGCCGGCTTT

CCCCGTCAAGCTCTAAATCGGGGGCTCCGTTTAGGGTTCCGATTTAGTGCTTTACGGCACCTCGACCCC

AAAAAACTTGATTAGGGTGATGGTTCACGTAGTGGGCCATCGCCCTGATAGACGGTTTTTGGCCCTTTG

ACGTTGGAGTCCACGTTGTTTAATAGTGGACTCTTGTTGCAAACTGGAACAACACTCAACCCTATCTCG

GTCTATTCTTTTGATTTATAAGGGATTTTGCCGATTTCGGCCTATTGGTTAAAAAATGAGCTGATTTAA

CAAAAATTTAACGCGAATTTTAACAAAATATTAACGCTTACAATTTAGGTGGCACTTTTCGGGGAAATG

TGCGCGGAACGCCTATTTGTTTATTTTTCTAAATACATTCAAATATGTATCCGCTCATGAGACAATAAC

CCTGATAAATGCTTCAATAATATTGAAAAGGAAGAGTATGAGTATTCAACATTTCCGTGTCGCGGTTA

TTCCCTTTTTTGCGGCATTTTGCCTTCCTGTTTTTGCTCACCCAGAAACGCTGGTGAAAGTAAAAGATG
```

-continued

```
CTGAAGATCAGTTGGGTGGAGGAGTGGGTTACATCGAACTGGATCTCAACAGCGGTAAGATCCTTGAGA
GTTTTCGCCCCGAAGAACGTTTTCCAATGATGAGCACTTTTAAAGTTCTGCTATGTGGCGCGGTATTAT
CCCGTATTGACGCCGGGCAAGAGCAACTCGGTGGCCGCATAGACTATTCTCAGAATGACTTGGTTGAGT
ACTCAGCAGTCACAGAAAAGCATCTTACGGATGGCATGACAGTAAGAGAATTATGCAGTGCTGCCATAA
CCATGAGTGATAACACTGCGGCCAACTTACTTCTGACAACGATGGGAGGACCGAAGGAGCTAACCGCTT
TTTTGCACAACATGGGGGATCATGTAACTCGCCTTGATCGTTGGGAACCGGAGCTGAATGAAGCCATAC
CAAACGACGAGCGTGACACCACGATGCCTGTAGCAATGGCAACAACGTTGCGCAAACTATTAACTGGCG
AACTACTTAGTCTAGCTTCCCGGCAACAATTAATAGACTGGATGGAGGCGGATAAAGTTGCAGGACCAC
TTCTGCGCTCGGCCGTTCCGGCTGGCTGGTTTATTGCTGATAAATCTGGAGCCGGTGAGCGTGGGTCTG
GCGGTATCATTGCAGCACTGGGGCCAGATGGTAAGCCCTCCCGTATCGTAGTTATCTACACGACGGGGA
GTCAGGCAACTATGGATGAACGAAATAGACAGATCGCTGAGATAGGTGCCTCACTGATTAAGCATTGGT
AACTGTCAGACCAAGTTTACTCATATATACTTTAGATTGATTTAAAACTTCATTTTTAATTTAAAAGGA
TCTAGGTGAAGATCCTTTTTGATAATCTCATGACCAAAATCCCTTAACGTGAGTTTTCGTTCCACTGAG
CGTCAGACGCCGTAGAAAAGATCAAAGGATCTTCTTGAGATCCTTTTTTTCTGCGCGTAATCTGCTGCT
TGCAAACAAAAAAACCACCGCTACCAGCGGTGGTTTGTTTGCCGGATGAAGAGCTACCAACTCTTTTTC
CGAAGGTAACTGGCTTCAGCAGAGCGCAGATACCAAATACTGTGCTTCTAGTGTAGCCGTAGTTAGGCC
ACCAGTTCAAGAACTCTGTAGCACCGCCTACATACCTCGCTCTGCTAATCCTGTTACCAGTGGCTGCTG
CCAGTGGCGATAAGTCGTGTGTTACCGGGTTGGACTCAAGACGATAGTTACCGGATAAGGCGCAGCGGT
CGGGCTGAACGGGGGGTTCGTGCACACAGCCCAGCTTGGAGCGAACGACCTACACCGAACTGAGATAGG
TACAGCGTGAGCTATGAGAAAGCGCCACGCTTCCCGAAGGGAGAAAGGCGGACAGGTATCCGGTAAGCG
GCAGGGTCGGAACAGGAGAGCGCACGAGGGAGCTTCCAGGGGGAAACGCCTGGTATCTTTATAGTCCTG
TCGGGTTTCGCCACCTCTGACTTGAGCGTCGATTTTTGTGATGCTCGTCAGGGGGCGGAGCCTATGGA
AAAACGCCAGCAACGCGGCCTTTTTACGGTTCCTGGCCTTTTGCTGGCCTTTTGCTCACATGTTCTTTC
CTGCGTTATCCCCTGATTCTGTGGATAACCGTATTACCGCCTTTGAGTGAGCTGATAGCGCTCGCCGCA
GCGGAACGACCGAGCGCAGCGAGTCAGTGAGCGAGGAAGCGGAAGAGCGCCCAATACGCAAACCGCCTC
TCCCCGCGCGTTGGCCGATTCATTAATGCAGCTGGCACGACAGGTTTCCCGACTGGAAAGCGGGCAGTG
AGCGCAAGGCAATTAATGTGAGTTAGCTCACTCATTAGGCACCCCAGGCTTTACACTTTATGCTTCCGG
CTCGTATGTTGTGTGGAATTGTGAGCGGATAACAATTTCACACAGGAAACAGCTATGACCATGATTACG
CCAAGCGCGCAATTAACCCTGACTAAAGGGAACAAAAGCTGGGGCCGCTCTAG
```

TABLE 8 pGrowth Information.

| CW AR | Plasmid(s) | Promoter | Gene | Genesis ID |
|---|---|---|---|---|
| 88 | pGrowth14 | SUBIN | Cyclin A | prga001823 |
| 88 | pGrowth15 | SUBIN | Cyclin A | prpe001264 |
| 88 | pGrowth16 | SUBIN | Cyclin D | prxa004540 |
| 88 | pGrowth18 | SUBIN | Cyclin D | prx1006271 |
| 88 | pGrowth19 | SUBIN | Cyclin D | prpb019661 |
| 88 | pGrowth20 | SUBIN | WEE1-like protein | prrd041233 |

To make the growth100 plasmids, an acceptor vector (pWVK202) was built by first inserting the NotI-SUBIN:: UDPGBD::nos term-NotI cassette from pARB483a into plasmid pWVK147 at NotI. Next, the UDPGBD gene was removed using restriction sites PstI and ClaI. A polylinker containing the restriction sites PstI, NheI, AvrII, ScaI, and ClaI was inserted in place of the UDPGBD gene. Sites AvrII and NheI are both compatible with SpeI, a site found often in the plasmids provided by Genesis. ScaI is blunt, so any fragment can be blunted and then inserted at that position into the acceptor vector. Plasmids were received from Genesis and analyzed to determine which restriction sites would be most suitable for subcloning into the acceptor vector pWVK202. After the ligations were performed, the resulting products were checked by extensive restriction digest analysis to make sure that the desired plasmid had been created.

TABLE 9

*Eucalyptus grandis* Cell Cycle Genes and Proteins.

| DNA SEQ ID NO | Protein SEQ ID NO | Sequence Identifier | Patent ORF start | Patent ORF stop |
|---|---|---|---|---|
| 1 | 261 | eucalyptusSpp_003910 | 387 | 1820 |
| 2 | 262 | eucalyptusSpp_019213 | 99 | 1007 |
| 3 | 263 | eucalyptusSpp_036800 | 120 | 1004 |
| 4 | 264 | eucalyptusSpp_040260 | 23 | 937 |
| 5 | 265 | eucalyptusSpp_041965 | 149 | 1033 |
| 6 | 266 | eucalyptusSpp_002906 | 199 | 1116 |
| 7 | 267 | eucalyptusSpp_001518 | 41 | 982 |
| 8 | 268 | eucalyptusSpp_008078 | 291 | 2042 |
| 9 | 269 | eucalyptusSpp_009826 | 107 | 2236 |
| 10 | 270 | eucalyptusSpp_010364 | 82 | 1749 |
| 11 | 271 | eucalyptusSpp_011523 | 151 | 1560 |
| 12 | 272 | eucalyptusSpp_024358 | 82 | 1644 |
| 13 | 273 | eucalyptusSpp_039125 | 626 | 2782 |
| 14 | 274 | eucalyptusSpp_005362 | 13 | 1467 |
| 15 | 275 | eucalyptusSpp_044857 | 113 | 1558 |
| 16 | 276 | eucalyptusSpp_001743 | 187 | 1686 |
| 17 | 277 | eucalyptusSpp_012405 | 238 | 1653 |
| 18 | 278 | eucalyptusSpp_003739 | 235 | 1539 |
| 19 | 279 | eucalyptusSpp_022338 | 158 | 1618 |
| 20 | 280 | eucalyptusSpp_028605 | 205 | 1530 |
| 21 | 281 | eucalyptusSpp_041006 | 174 | 1499 |
| 22 | 282 | eucalyptusSpp_006643 | 94 | 1332 |
| 23 | 283 | eucalyptusSpp_045338 | 176 | 1342 |
| 24 | 284 | eucalyptusSpp_046486 | 150 | 1283 |
| 25 | 285 | eucalyptusSpp_012070 | 101 | 367 |
| 26 | 286 | eucalyptusSpp_006617 | 9 | 1352 |
| 27 | 287 | eucalyptusSpp_007827 | 89 | 1486 |
| 28 | 288 | eucalyptusSpp_008036 | 80 | 1477 |
| 29 | 289 | eucalyptusSpp_001597 | 160 | 1062 |
| 30 | 290 | eucalyptusSpp_001596 | 172 | 1077 |
| 31 | 291 | eucalyptusSpp_005870 | 66 | 989 |
| 32 | 292 | eucalyptusSpp_006901 | 111 | 1541 |
| 33 | 293 | eucalyptusSpp_006902 | 116 | 1615 |
| 34 | 294 | eucalyptusSpp_007440 | 155 | 1453 |
| 35 | 295 | eucalyptusSpp_008994 | 228 | 2033 |
| 36 | 296 | eucalyptusSpp_024580 | 110 | 1258 |
| 37 | 297 | eucalyptusSpp_037831 | 50 | 1462 |
| 38 | 298 | eucalyptusSpp_034958 | 176 | 739 |
| 39 | 299 | eucalyptusSpp_022967 | 150 | 1529 |
| 40 | 300 | eucalyptusSpp_008599 | 247 | 1971 |
| 41 | 301 | eucalyptusSpp_009919 | 136 | 1644 |
| 42 | 302 | eucalyptusSpp_015820 | 48 | 836 |
| 43 | 303 | eucalyptusSpp_008327 | 49 | 822 |
| 44 | 304 | eucalyptusSpp_004604 | 185 | 751 |
| 45 | 305 | eucalyptusSpp_000966 | 103 | 621 |
| 46 | 306 | eucalyptusSpp_001037 | 41 | 559 |
| 47 | 307 | eucalyptusSpp_004603 | 127 | 693 |
| 48 | 308 | eucalyptusSpp_005465 | 28 | 639 |
| 49 | 309 | eucalyptusSpp_006571 | 135 | 812 |
| 50 | 310 | eucalyptusSpp_006786 | 119 | 613 |
| 51 | 311 | eucalyptusSpp_007057 | 38 | 562 |
| 52 | 312 | eucalyptusSpp_008670 | 109 | 1872 |
| 53 | 313 | eucalyptusSpp_009137 | 74 | 1159 |
| 54 | 314 | eucalyptusSpp_010285 | 54 | 2045 |
| 55 | 315 | eucalyptusSpp_010600 | 53 | 1879 |
| 56 | 316 | eucalyptusSpp_011551 | 7 | 690 |
| 57 | 317 | eucalyptusSpp_020743 | 83 | 601 |
| 58 | 318 | eucalyptusSpp_023739 | 125 | 535 |
| 59 | 319 | eucalyptusSpp_024103 | 55 | 573 |
| 60 | 320 | eucalyptusSpp_031985 | 147 | 842 |
| 61 | 321 | eucalyptusSpp_032025 | 167 | 487 |
| 62 | 322 | eucalyptusSpp_032173 | 195 | 890 |
| 63 | 323 | eucalyptusSpp_033340 | 68 | 586 |
| 64 | 324 | eucalyptusSpp_009143 | 182 | 3265 |
| 65 | 325 | eucalyptusSpp_000349 | 165 | 1145 |
| 66 | 326 | eucalyptusSpp_000575 | 529 | 1569 |
| 67 | 327 | eucalyptusSpp_000804 | 156 | 1136 |
| 68 | 328 | eucalyptusSpp_000805 | 90 | 1073 |
| 69 | 329 | eucalyptusSpp_000806 | 66 | 1049 |
| 70 | 330 | eucalyptusSpp_002248 | 277 | 1512 |
| 71 | 331 | eucalyptusSpp_003203 | 33 | 1076 |
| 72 | 332 | eucalyptusSpp_003209 | 65 | 973 |
| 73 | 333 | eucalyptusSpp_004429 | 82 | 1047 |
| 74 | 334 | eucalyptusSpp_004607 | 43 | 1101 |
| 75 | 335 | eucalyptusSpp_004682 | 142 | 1095 |
| 76 | 336 | eucalyptusSpp_005786 | 61 | 1257 |
| 77 | 337 | eucalyptusSpp_005887 | 193 | 1527 |
| 78 | 338 | eucalyptusSpp_005981 | 109 | 1155 |
| 79 | 339 | eucalyptusSpp_006766 | 71 | 1213 |
| 80 | 340 | eucalyptusSpp_006769 | 109 | 1785 |
| 81 | 341 | eucalyptusSpp_006907 | 364 | 2685 |
| 82 | 342 | eucalyptusSpp_007518 | 96 | 1412 |
| 83 | 343 | eucalyptusSpp_007717 | 116 | 1702 |
| 84 | 344 | eucalyptusSpp_007718 | 46 | 1101 |
| 85 | 345 | eucalyptusSpp_007741 | 23 | 1258 |
| 86 | 346 | eucalyptusSpp_007884 | 404 | 2644 |
| 87 | 347 | eucalyptusSpp_008258 | 107 | 2383 |
| 88 | 348 | eucalyptusSpp_008465 | 243 | 1625 |
| 89 | 349 | eucalyptusSpp_008616 | 126 | 1127 |
| 90 | 350 | eucalyptusSpp_008690 | 257 | 1390 |
| 91 | 351 | eucalyptusSpp_008708 | 178 | 1632 |
| 92 | 352 | eucalyptusSpp_008850 | 290 | 2917 |
| 93 | 353 | eucalyptusSpp_009072 | 148 | 1197 |
| 94 | 354 | eucalyptusSpp_009465 | 140 | 1567 |
| 95 | 355 | eucalyptusSpp_009472 | 376 | 1737 |
| 96 | 356 | eucalyptusSpp_009550 | 69 | 1010 |
| 97 | 357 | eucalyptusSpp_010284 | 149 | 1423 |
| 98 | 358 | eucalyptusSpp_010595 | 365 | 2677 |
| 99 | 369 | eucalyptusSpp_010657 | 24 | 923 |
| 100 | 360 | eucalyptusSpp_012636 | 221 | 3598 |
| 101 | 361 | eucalyptusSpp_012748 | 44 | 1447 |
| 102 | 362 | eucalyptusSpp_012879 | 196 | 1314 |
| 103 | 363 | eucalyptusSpp_015515 | 193 | 1668 |
| 104 | 364 | eucalyptusSpp_015724 | 78 | 1634 |
| 105 | 365 | eucalyptusSpp_016167 | 85 | 2826 |
| 106 | 366 | eucalyptusSpp_016633 | 74 | 1246 |
| 107 | 367 | eucalyptusSpp_017485 | 100 | 4377 |
| 108 | 368 | eucalyptusSpp_018007 | 58 | 2439 |
| 109 | 369 | eucalyptusSpp_020775 | 159 | 1064 |
| 110 | 370 | eucalyptusSpp_023132 | 118 | 1665 |
| 111 | 371 | eucalyptusSpp_023569 | 57 | 1628 |
| 112 | 372 | eucalyptusSpp_023611 | 250 | 1566 |
| 113 | 373 | eucalyptusSpp_024934 | 106 | 1434 |
| 114 | 374 | eucalyptusSpp_025546 | 190 | 1917 |
| 115 | 375 | eucalyptusSpp_030134 | 102 | 2942 |
| 116 | 376 | eucalyptusSpp_031787 | 75 | 1079 |
| 117 | 377 | eucalyptusSpp_034435 | 99 | 1148 |
| 118 | 378 | eucalyptusSpp_034452 | 232 | 1806 |
| 119 | 379 | eucalyptusSpp_035789 | 72 | 1124 |
| 120 | 380 | eucalyptusSpp_035804 | 315 | 2069 |
| 121 | 381 | eucalyptusSpp_043057 | 145 | 1968 |
| 122 | 382 | eucalyptusSpp_046741 | 130 | 1488 |
| 123 | 383 | eucalyptusSpp_047161 | 269 | 1693 |
| 235 | 495 | eucalyptusSpp_006366 | 117 | 1580 |
| 236 | 496 | eucalyptusSpp_017378 | 111 | 1700 |
| 252 | 512 | eucalyptusSpp_045414 | 238 | 1648 |
| 253 | 513 | eucalyptusSpp_044328 | 59 | 859 |
| 254 | 514 | eucalyptusSpp_015615 | 44 | 1829 |
| 255 | 515 | eucalyptusSpp_017239 | 109 | 1866 |
| 256 | 516 | eucalyptusSpp_018643 | 212 | 1815 |
| 257 | 517 | eucalyptusSpp_019127 | 207 | 1193 |
| 258 | 518 | eucalyptusSpp_022624 | 6 | 2786 |
| 259 | 519 | eucalyptusSpp_032424 | 213 | 1726 |
| 260 | 520 | eucalyptusSpp_037472 | 101 | 2110 |

TABLE 10

*Pinus radiata* cell cycle genes and proteins.

| DNA SEQ ID NO | Protein SEQ ID NO | Sequence Identifier | Patent ORF start | Patent ORF stop |
|---|---|---|---|---|
| 124 | 384 | pinusRadiata_001766 | 1163 | 2545 |
| 125 | 384 | pinusRadiata_002927 | 152 | 1582 |
| 126 | 385 | pinusRadiata_007642 | 389 | 1297 |
| 127 | 386 | pinusRadiata_013714 | 38 | 946 |
| 128 | 387 | pinusRadiata_016332 | 180 | 1088 |
| 129 | 388 | pinusRadiata_021677 | 40 | 948 |
| 130 | 389 | pinusRadiata_027562 | 229 | 1134 |
| 131 | 390 | pinusRadiata_001504 | 105 | 2642 |
| 132 | 391 | pinusRadiata_015211 | 187 | 2580 |
| 133 | 392 | pinusRadiata_020421 | 220 | 1749 |
| 134 | 393 | pinusRadiata_003187 | 438 | 1748 |
| 135 | 394 | pinusRadiata_015661 | 240 | 1631 |
| 136 | 395 | pinusRadiata_013874 | 252 | 1604 |
| 137 | 396 | pinusRadiata_014615 | 261 | 1817 |
| 138 | 397 | pinusRadiata_004578 | 167 | 1576 |
| 139 | 398 | pinusRadiata_023387 | 183 | 1598 |
| 140 | 399 | pinusRadiata_006970 | 98 | 1126 |
| 141 | 400 | pinusRadiata_010322 | 148 | 894 |
| 142 | 401 | pinusRadiata_022721 | 287 | 1363 |
| 143 | 402 | pinusRadiata_023407 | 251 | 1348 |
| 144 | 403 | pinusRadiata_001945 | 229 | 510 |
| 145 | 404 | pinusRadiata_008233 | 92 | 409 |
| 146 | 405 | pinusRadiata_008234 | 64 | 381 |
| 147 | 406 | pinusRadiata_022054 | 68 | 349 |
| 148 | 407 | pinusRadiata_012137 | 125 | 1849 |
| 149 | 408 | pinusRadiata_012582 | 70 | 1602 |
| 150 | 409 | pinusRadiata_015285 | 140 | 1465 |
| 151 | 410 | pinusRadiata_017229 | 628 | 2565 |
| 152 | 411 | pinusRadiata_020724 | 55 | 1818 |
| 153 | 412 | pinusRadiata_004555 | 259 | 1710 |
| 154 | 413 | pinusRadiata_004556 | 356 | 1807 |
| 155 | 414 | pinusRadiata_005729 | 261 | 1298 |
| 156 | 415 | pinusRadiata_007395 | 365 | 2251 |
| 157 | 416 | pinusRadiata_009503 | 156 | 1454 |
| 158 | 417 | pinusRadiata_011283 | 203 | 1348 |
| 159 | 418 | pinusRadiata_012322 | 229 | 1644 |
| 160 | 419 | pinusRadiata_018671 | 156 | 1454 |
| 161 | 420 | pinusRadiata_023236 | 27 | 2222 |
| 162 | 421 | pinusRadiata_000171 | 71 | 1759 |
| 163 | 422 | pinusRadiata_000172 | 358 | 2040 |
| 164 | 423 | pinusRadiata_001480 | 238 | 756 |
| 165 | 424 | pinusRadiata_001481 | 285 | 803 |
| 166 | 425 | pinusRadiata_001483 | 190 | 708 |
| 167 | 426 | pinusRadiata_001484 | 156 | 674 |
| 168 | 427 | pinusRadiata_001692 | 176 | 1912 |
| 169 | 428 | pinusRadiata_005313 | 64 | 765 |
| 170 | 429 | pinusRadiata_006362 | 93 | 881 |
| 171 | 430 | pinusRadiata_006493 | 372 | 1070 |
| 172 | 431 | pinusRadiata_006983 | 28 | 594 |
| 173 | 432 | pinusRadiata_006984 | 34 | 648 |
| 174 | 433 | pinusRadiata_007665 | 481 | 1611 |
| 175 | 434 | pinusRadiata_012196 | 93 | 584 |
| 176 | 435 | pinusRadiata_013382 | 250 | 1869 |
| 177 | 436 | pinusRadiata_016461 | 84 | 422 |
| 178 | 437 | pinusRadiata_017611 | 128 | 1213 |
| 179 | 438 | pinusRadiata_019776 | 265 | 837 |
| 180 | 439 | pinusRadiata_020659 | 38 | 781 |
| 181 | 440 | pinusRadiata_022559 | 38 | 526 |
| 182 | 441 | pinusRadiata_024188 | 37 | 1158 |
| 183 | 442 | pinusRadiata_027973 | 61 | 768 |
| 184 | 443 | pinusRadiata_001353 | 421 | 2172 |
| 185 | 444 | pinusRadiata_001978 | 163 | 1647 |
| 186 | 445 | pinusRadiata_002810 | 192 | 1172 |
| 187 | 446 | pinusRadiata_002811 | 131 | 1111 |
| 188 | 447 | pinusRadiata_002812 | 149 | 1726 |
| 189 | 448 | pinusRadiata_003514 | 948 | 2228 |
| 190 | 449 | pinusRadiata_004104 | 332 | 1465 |
| 191 | 450 | pinusRadiata_005595 | 232 | 1590 |
| 192 | 451 | pinusRadiata_005754 | 207 | 1550 |
| 193 | 452 | pinusRadiata_006463 | 221 | 1171 |
| 194 | 454 | pinusRadiata_006665 | 221 | 3679 |
| 195 | 455 | pinusRadiata_006750 | 269 | 1252 |
| 196 | 456 | pinusRadiata_007030 | 214 | 1242 |
| 197 | 457 | pinusRadiata_007854 | 119 | 2065 |
| 198 | 458 | pinusRadiata_007917 | 186 | 1550 |
| 199 | 459 | pinusRadiata_007989 | 244 | 3671 |
| 200 | 460 | pinusRadiata_008506 | 163 | 1431 |
| 201 | 461 | pinusRadiata_008692 | 155 | 1081 |
| 202 | 462 | pinusRadiata_008693 | 537 | 1463 |
| 203 | 463 | pinusRadiata_009170 | 284 | 1909 |
| 204 | 464 | pinusRadiata_009408 | 610 | 1659 |
| 205 | 465 | pinusRadiata_009522 | 241 | 1452 |
| 206 | 466 | pinusRadiata_009734 | 223 | 1173 |
| 207 | 467 | pinusRadiata_009815 | 251 | 1777 |
| 208 | 468 | pinusRadiata_010670 | 367 | 1419 |
| 209 | 469 | pinusRadiata_011297 | 284 | 1303 |
| 210 | 470 | pinusRadiata_013098 | 684 | 1784 |
| 211 | 471 | pinusRadiata_013172 | 336 | 2738 |
| 212 | 472 | pinusRadiata_013589 | 81 | 1622 |
| 213 | 473 | pinusRadiata_013608 | 399 | 1460 |
| 214 | 474 | pinusRadiata_014299 | 207 | 1673 |
| 215 | 475 | pinusRadiata_014498 | 263 | 1309 |
| 216 | 476 | pinusRadiata_014548 | 232 | 2529 |
| 217 | 477 | pinusRadiata_014610 | 56 | 2950 |
| 218 | 478 | pinusRadiata_016090 | 193 | 2577 |
| 219 | 479 | pinusRadiata_016722 | 187 | 1233 |
| 220 | 480 | pinusRadiata_016785 | 51 | 1436 |
| 221 | 481 | pinusRadiata_017094 | 525 | 2351 |
| 222 | 482 | pinusRadiata_017527 | 152 | 1099 |
| 223 | 483 | pinusRadiata_017591 | 470 | 4114 |
| 224 | 484 | pinusRadiata_017769 | 196 | 2007 |
| 225 | 485 | pinusRadiata_018047 | 214 | 1323 |
| 226 | 486 | pinusRadiata_018414 | 68 | 2146 |
| 227 | 487 | pinusRadiata_018986 | 874 | 3705 |
| 228 | 488 | pinusRadiata_019479 | 360 | 1754 |
| 229 | 489 | pinusRadiata_020144 | 185 | 1384 |
| 230 | 490 | pinusRadiata_022480 | 241 | 1533 |
| 231 | 491 | pinusRadiata_023079 | 230 | 1435 |
| 232 | 492 | pinusRadiata_026739 | 101 | 2857 |
| 233 | 493 | pinusRadiata_026951 | 43 | 1548 |
| 234 | 494 | pinusRadiata_026529 | 206 | 1657 |
| 237 | 497 | pinusRadiata_000888 | 144 | 1412 |
| 238 | 498 | pinusRadiata_014166 | 793 | 1683 |
| 239 | 499 | pinusRadiata_003189 | 415 | 2196 |
| 240 | 500 | pinusRadiata_009356 | 109 | 1653 |
| 241 | 501 | pinusRadiata_000065 | 343 | 1023 |
| 242 | 502 | pinusRadiata_014197 | 417 | 2351 |
| 243 | 503 | pinusRadiata_009081 | 69 | 641 |
| 244 | 504 | pinusRadiata_013417 | 172 | 1623 |
| 245 | 505 | pinusRadiata_005755 | 231 | 1768 |
| 246 | 506 | pinusRadiata_006670 | 376 | 2943 |
| 247 | 507 | pinusRadiata_007027 | 107 | 1498 |
| 248 | 508 | pinusRadiata_007276 | 118 | 1425 |
| 249 | 509 | pinusRadiata_007390 | 186 | 797 |
| 250 | 510 | pinusRadiata_012648 | 387 | 2456 |
| 251 | 511 | pinusRadiata_013171 | 359 | 2761 |

TABLE 11

Annotated Peptide Sequences of the Present Invention.

| Entry | Sequence Description | Annotated Peptide Sequence |
|---|---|---|
| 1 | The amino acid sequence of SEQ ID 261. The conserved eukaryotic protein kinase domain is underlined and the serine/threonine protein kinases active-site signature is in bold. | MGDSLGSGGRGNSGGGGGGSRPEWLQQYDLIGKIGEG TYGLVFLARIKHPSTNRGKYIAIKKFKQSKDGDGVSPTA IREIMLLREISHENVVKLVNVHINPVDMSLYLAFDYADH DLYEIIRHHRDKVNQAINPYTVKSLLWQLLNGLNYLHSN WIIHRDLKPSNILVMGEGEEQGVVKIADFGLARVYQAPL KPLSDNGVVVTIWYRAPELLLGAKHYTSAVDMWAVGCIF AELLTLKPLFQGQEVKANPNPFQLDQLDKIFKVLGHPTQ EKWPMLVNLPHWQSDVQHIQRHKYDDNALGNVVRLSSKN ATFDLLSKMLEYDPQKRITAAQALEHEYFRMEPLPGRNA LVPSSPGDKVNYPTRPVDTTTDIEGTTSLQPSQSASSGN AVPGNMPGPHVVTNRPMPRPMEMVGMQRVPASGMAGYNL NPSGMGGGMNPSGIPMQRGVANQAQQSRRKDPGMGMGGY PPQQKQRRF |
| 2 | The amino acid sequence of SEQ ID 262. The conserved eukaryotic protein kinase domain is underlined and the protein kinases ATP-binding region and serine/threonine protein kinases active-site signatures are in bold. | MEKYQQLAKIGEGTYGIVYKAKDKKSGELIALKKIRLEA EDECIPSTAIREISLLRQLQHPNIVRLYDVVHTEKKLTL VFEFLDQDLKKYLDACGDNGLEPYTVKSFLYQLLQGIAF CHEHRVLHEDLKPQNLLINMEGELKLADFGLAPAFGIPV RNYTHEVVTLWYRAPDVLMGSRKYSTQVDIWSVGCIFAE MVNGRPLFPGSSEQDQLLRIFKTLGTPSLKTWPGMAELP DFKDNFPKYVVQSFKKICPKKLDKTGLDLLSRMLQYDPA KRISAEQAMGHPYFKDLKLRKPKAAGPGP |
| 3 | The amino acid sequence of SEQ ID 263. The conserved eukaryotic protein kinase domain is underlined and the protein kinases ATP-binding region and serine/threonine protein kinases active-site signatures are in bold. | MDQYEKIEKIGEGTYGVVYKAIDRSTNKTIALKKIRLEQ EDEGVPSTAIREISLLKEMQHGNIVKLQDVVHSERRLYL VFEYLDLDLKKHNDSCPEFSKDTHTIKNFLYQILRGISY CHSHRVLHEDLKPQNLLLDRRTNSLKLADFGLARAFGIP VRTFTHEVVTLWYRAPEILLGSRHYSTPVDVWSVGCIFA EMVNRRPLFPGDSEIDELFKIFRIMGTPNEDSWPGVTSL PDFKSTFPKWASQDLKTVTPTVDPAGIDLLSKNLCMDPR RRITAKVALEHEYFKDVGVIP |
| 4 | The amino acid sequence of SEQ ID 264. The conserved eukaryotic protein kinase domain is underlined and the protein kinases ATP-binding region and serine/threonine protein kinases active-site signatures are in bold. | MVNKSKLDKYEKLEKIGEGTYGVVYKAQDKTTKEIYALK KIRLESEDEGIPSTAIREIALLKELQHPNVVRIHDVIHT NKKLILVFEFVDYDLKKFLHNFDKGIDPKIVKSLLYQLV RGVAHCHQQKVLHEDLKPQNLLVSQEGILKLGDFGLARA FGIPVKNYTNEVVTLWYRAPDILLGSKNYSTSVDIWSIG CIFVEMLNQRPLFPGSSEQDQLKKIFKIMGTPDATKWPG IAELPDWKPENFEKYPGEPLNKVCPRMDPDGLDLLDKML KCNPSERIAAKNANSHPYFKDIPDNLKKLYN |
| 5 | The amino acid sequence of SEQ ID 265. The conserved eukaryotic protein kinase domain is underlined and the protein kinases ATP-binding region and serine/threonine protein kinases active-site signatures are in bold. | MDQYEKVEKIGEGTYCVVYKAIDRLTNETIALKKIRLEQ EDEGVPSTAIREISLLKEMQHGNIVRLQDVVHSENRLYL VFEYLDLDLKKHMDSSPDFAKDPRLVKIFLYQILRGIAY CHSHRVLHRDLKPQNLLIDRRTNALRLADFGLARAFGIP VRTFTHEVVTLWYRAPEILLGSRHYSTPVDVWSVGCIFA EMVNQRPLFPGDSEIDELFKIFRILGTPNEDTWPGVTAL PDFKSAFPKWPAKNLQDMVPGLNSAGIDLLSKMLCLDPS KRITARSALEHEYFKDIGFVP |
| 6 | The amino acid sequence of SEQ ID 266. The conserved eukaryotic protein kinase domain is underlined and the protein kinases ATP-binding region and serine/threonine protein kinases active-site signatures are in bold. | MEKYEKLEKVGEGTYGKVYKAKDKATGQLVALKKTRLEM DEEGVPPTALREVSLLQLLSQSLYVVRLLSVEHVDGGSK RKAAAAAAAEGGGGEAHGGGAVGGGKPMLYLVFEYLDTD LKKFIDSHRKGPNPRPVPAATVQNFLYQLLKGVAHCSH GVLHRDLKPQNLLVDKEKGILKIADLGLGRAFTVPLKSY THEVFAFLAILLWRSEGESAADFDSXFRVSPVQVVTLWY RAPEVLLGSAHYSIGVDMWSVGCIFAENVRRQALFPGDS EFQQLLHIFRLLGTPTEKQWPGVTTLRDWHVYPQWEPQN LARAVPSLGPDGVDLLSKMLKYDPAERISAKAALDHPFF DSLDKSQF |
| 7 | The amino acid sequence of SEQ ID 267. The conserved eukaryotic protein kinase domain is underlined and the protein kinases ATP-binding region and serine/threonine protein kinases active-site signatures are in bold. | MERPATAAVSAMEAFEKLEKVGEGTYGKVYRAPEKATGK IVALKKTRLHEDEEGVPPTTLREISILRMLSRDPHIVRL MDVKQGQNKEGKTVLYLVFEYMETDLKKYIRGFRSSGES IPVNIVKSLMYQLCKGVAFCHGHGVLHRDLKPHNLIMDK KTLTLKIADLGLARAFTVPIKKYTHEILTLWYRAPEVLL GATHYSTAVDMWSVGCIEABLVTKQALFPGDSELQQLLH IFRLLGTPNEKNWPGVSSLMNWHEYPQWKPQSLSTAVPN LDKDGLDLLSQMLHYEPSRRISAKAAMEHPYFDDVNKTC L |
| 8 | The amino acid sequence of SEQ ID 268. The conserved eukaryotic protein kinase domain is underlined and the serine/threonine protein kinases | MGCVLGREVSSGIVTESKGRDSSEVETSKRDDSVAAKVE GEGKAEEVRTEETQKKEKVEDDQQSREQRRRSKPSTKLG NLPKHIRGEQVAAGWPSWLSDICGEALNGWIPRRANTFE KIDKIGQGTYSNVYKAKDLLTGKIVALKKVRFDNLEPES VRFMAREILILRHLDHPNVVKLEGLVTSRMSCSLYLVFE |

TABLE 11-continued

Annotated Peptide Sequences of the Present Invention.

| Entry | Sequence Description | Annotated Peptide Sequence |
|---|---|---|
| | active-site signature is in bold. | YMEHDLAGLAASPAIKFTEPQVKCYMHQLLSGLEHCHNR RVLHRDIKGSNLLIDNGGVLKIGDPFGLASFYDPDHKHRN TSRVVTLWYRPPELLLGANDYGVGIDLWSAGCILAELLA GKPIMPGRTEVEQLHKIYKLCGSPSEEYWKKYKLPNATL FKPREPYRRCIRETFKDFPPSSLPLIETLLAIDPAERGT ATDALQSEFFRTEPYACEPSSLPQYPPSKEMDAKKRDDE ARRLRAASKGQADGSKKERTRDRRVRAVPAPEANAELQH NIDRRRLISHANAKSKSEKFPPPHQDGALGFPLGASHRF DPAVVPPDVPFTSTSFTSSKEEDQTWSGFLVDPPGAPRR KKHSAGGQRESSKLSMGTNKGRRADSHLKAYESKSIA |
| 9 | The amino acid sequence of SEQ ID 269. The conserved eukaryotic protein kinase domain is underlined and the serine/threonine protein kinase active-site signature is in bold. | MYSKSSAVDDSRESPKDRVSSSRRLSEVKTSRLDSSRRE NGFRARDKVGDVSVMLIDKKVNGSARFCDDQIEKKSDRL QKQRRERAEAAAAADHPGAGRVPKAVEGEQVAAGWPVWL SAVAGEAIRGWLPRRADT<u>FEKLDKIGQGTYSSVYKARDV TNNKIVALKRVRFDNLDTESVKFMAREIHILRMLDHPNV IKLEGLITSRMSCSLYLVFEYMEHDLTGLASRPDVKFSE PQIKCYMKQLLSGLDNCHKHGVLHRDIKGSNLLIDNNGI LKIADFGLASVFDPHQTAPLTSRVVTLWYRPPELLLGAS RYGVEVDLWSTGCILGELYTGKPILPGKTEVEQLHKIFK LCGSPSDDYWRRLHLPRAAVFKPPQPYRRCVAEIFKELP PVALGLLETLISVDPSQRGTAAFALRSEFFTASPLPCDP</u> SSLPKYPPSKEIDMKLREEEARRRGAAGGKNELEKRGTK DSRTNSAYYPNAGQLQVKQCHSNANGRSEIFGPYQEKTV SGFLVAPPKQARVSKETRKDYAEQPDRASFSGFLVPGPG FSKAGKELGHSITVSRNTNLSTLSSLVTSRTGDNKQKSG PLVSESANQASRYSGPIREMEPARKQDRRSHVRTNIDYR SREDGNSSTKEPALYGRGSAGNKIYVSGPLLVSSNNVDQ MLKEHDRRIQEHARRARFDKARVGNNHPQAAVDSKLVSV HDAG |
| 10 | The amino acid sequence of SEQ ID 270. The conserved eukaryotic protein kinase domain is underlined and the serine/threonine protein kinase active-site is in bold | MGCIPTIISDGRRRSAAPD-KRRPRPRRSSSEGEAPPHAT AAGSEGGESARGAPGKERPEPAPRFVVRSPQGWPPWLVA AVGRAIGEFVPRCADS<u>FRKLAKIGEGTYSNVYKARDLVT GKTVALKKVRFDNLEAESIKFMAREILVLTRLNHPNVIK LEGPVTSRMSSGLYLAFEYMEHDLSGIAARQNGKFTEPQ VKCFMRQLLSGLEHCHNHDVLHRDIKCSNLLIDNEGNLK IADFGLATFYDPERKQVMTNRVVTLWYRAPELLLGATSY GIGIDLWSAGCILAELLYGKPIMPGRTEVEQLHKIFKLC GSPSEAYWNKFKLPNANIFKPPQPYARCIAETFKDFPPS ALPLLETLLSIDPDERGTATTALNSEFFAAEPHACEPSS</u> LPKYPPSKEMDLKLIKEKTRRDSSKRPSAIHGSRRDGIH DRAGRVIPAPEATAENQATLHRPRAMKKANPMSRSEKFP PAMMOGVVGSSANAWLSGPASNAAPDSRRHRSLNQNPSS SVGKASTGSSTTQETLKVAPELLQVGSSSLHPCHRMLVY GSNLTIRSK |
| 11 | The amino acid sequence of SEQ ID 271. The conserved protein kinase family domain is underlined, and the serine/threonine protein kinases active-site signature is in bold | MGCICAKQADRGPASPGSGILTGAGTGTGTRSSKIPSGL FEFEKSGVKEHGGRSGELRKLEEKGSLSKRLRLELGFSH RYVEAEQAAAGWPSWLTAVAGDAIQGLVPLKADS<u>FEKLE KIGQGTYSSVFRARELANGRNVALKKVRFDNFQPESIQF MAREISILRRLDHPNIMKLEGIITSRNSNSIYLVFEYME HDLYGLISSPQVKFSDAQVKCYMKQLLSGIEHCHQHGVI HRDVKSSNILVNNEGILRIGDFGLANILNPKDRQQLTSH VVTLWYRPPELLMGSTSYGVTVDLWSVGCVFAELMFRKP ILRGRTEVEQLHKIFKLCGSPPDGYWKNCKVPQATMFRP RHAYECTLRERCKGIATSAMKLMETFLSIEPHKRGTASS ALISEYFRTVPYACDPSSLPKYPPNKEIDAKHREEARRK</u> KARSRVREAEVGKRPTRIHRASQEQGFSSNIAPKEKRSY A |
| 12 | The amino acid sequence of SEQ ID 272. The conserved eukaryotic protein kinase domain is underlined and the protein kinases ATP-binding region and serine/threonine protein kinases active-site signatures are in bold. | MAVAAPGHLNVNESPSWGSRSVDC<u>FEKLEQIGEGTYGQV YMAKEKKTGEIVALKKIRMDNEREGFPITAIREIKILEK LHHENVIKLKEIVTSPGPEKDEQGRPEGNKYKGGIYMVF EYMDHDLTGLADRPGMRFSVPQIKCYMRQLLTGLHYCHI NQVLHRDIKGSNLLIDNEGNLKLADFGLARSFSNDHNAN LTNRVITLWYRPPELLLGATKYGPAVDMWSVGCIFAELL HGKPIFPGKDEPEQLNKIFELCGAPDEINWPGVSKIPWY NNFKPTRPMKRRLREVFRHFDRHALELLERMLTDPSQR ISAKDALDAEYFWADPLPCDPKSLPKYESSHEFQTKKKR</u> QQQRQHEETAKRQKLQHPFQHPRLPPVQQSGQAHAQMRP |

TABLE 11-continued

Annotated Peptide Sequences of the Present Invention.

| Entry | Sequence Description | Annotated Peptide Sequence |
|---|---|---|
|  |  | GPNQLMHGSQPPVATGPPGHHYGKPRGPSGGAGRYPSSG NPGGGYNHPSRGGQGGSGGYNSGPYPPQGRAPPYGSSGM PGAGPRGGGNNYGVGPSNYPQGGGGPYGGSGAGRGSNM MGGNRNQQYGWQQ |
| 13 | The amino acid sequence of SEQ ID 273. The conserved serine/threonine protein kinase domain is underlined, and the serine/threonine protein kinase active-site signature is in bold. | MGCICTKGILPAHYRIKDGGLKLSKSSKRSVGSLRRDEL AVSANGGGNDAADRLISSPHEVENEVEDRKNVDFNEKLS KSLQRRATMDVASGGHTQAQLKVGKVGGFPLGERGAQVV AGWPSWLTAVAGEAINGWVPRRADSFEKLEKIGQGTYSS VYPARDLETNTIVALKKVRFANMDPESVRFMAREIIIMR KLDHPNVMKLEGLITSRVSGSLYLVFEYMDHDLAGLAAT PSIKLTESQIKCYMQQLLRGLEYCHSHGVLHRDIKGSNL LVDNNGNLKIGDFGLATFFRTNQKQPLTSRVVTLWYRPP ELLLGSSDYGASVDLWSSGCILAELFAGKPIMPGRTEVE QLHKIFKLCGSPSEEYWKKSKLPHATIFKPQQPYKRCLL ETFKDFPSSALGLLDVLLAVEPECRGTASSALQNEFFTS NPLPSDPSSLPKYPSSKEFDARLRDEEARKHKATAGKAR GLESIRKGSKESKVVPTSNANADLKASIQKRQEQSNPRS TGEKPGGTTQNNFILSGQSAKPSLNGSTQIGNANEVEAL IVPDRELDSPRGGAELRRQRSFMQRRASQLSRFSNSVAV GGDSHLDCSREKGANTQWRDEGFVARCSHPDGGELAGKH DWSHHLLHRPISLFKKGGEHSRRDSIASYSPKKGRIHYS GPLLPSGDNLDEMLKEHERQIQNAVRKARLDKVKTKREY ADHGQTESLLCWANGR |
| 14 | The amino acid sequence of SEQ ID 274. The conserved protein kinase family domain is underlined and the serine/threonine protein kinases active-site signature is in bold. | MDPDPSPDPDPPKSWSIHTRREIIARYEILERVGSGAYS DVYRGRRLSDGLAVALKEVHDYQSAFREIEALQILRGSP HVVLLHEYFWREDEDAVLVLEFLRSDLAAVIADASRRPR DGGGGGAAALRAGEVKRWMLQVLEGVDACHRNSIVHRDL KPGNLLISEEGVLKIADFGQARILLDDGNVAPDYEPESF EERSSEQADILQQPETMEADTTCPEGQEQGAITREAYLR EVDEFKAKNPRHEIDKETSIFDGDTSCLATCTTSDIGED PFKGSYVYGAEEAGEDAQGCLTSCVGTRWFRAPELLYGS TDYGLEVDLWSLGCIFAELLTLEPLEPGISDIDQLSRIF NVLGNLSEEVWPGCTKLPDYRTISFCKIENPIGLESCLP NCSSDEVSLVRRLLCYDPAARATPMELLQDKYFTEEPLP VPISALQVPQSKNSHDEDSAGGWYDYNDMDSDSDFEDFG PLKFTPTSTGFSIQFP |
| 15 | The amino acid sequence of SEQ ID 275. The conserved serine/threonine protein kinase domain is underlined, and the serine/threonine protein kinase active-site signature is in bold. | MDPDPSPSPDPPKSWSIHTRREIIARYEILERVGSGAYS DVYRGRRLSDGLAVALKEVHDYQSAFREIEALQILRGSP HVVLLHEYFWREDEDAVLVLEFLRSDLAAVIADASRRPR GGGVAPLRAGEGKRWMLQVLEGVDACHRNSIVHRDLKPG NLLISEEGVLKIADFGQARILLDDGNVAPDYEPESFEER SSEQADILQQPETMEADTTCPEGQEQGAITREAYLREVD EFKAKNPRHEIDKETSIYDGDTSCLATCTTSDIGEDPFK GSYVYGAEEAGEDAQGSLTSCVGTRWFRAPELLYGSTDY GLEVDLWSLGCIFAELLTLEPLFPGISDIDQLSRIFNVL GNLSEEVWPGCTKLPDYRTISFCKIENPIGLESCLPNCS SDEVSLVRRLLCYDPAARATPMELLQDKYFTEEPLPVPI SALQVPQSKNSHDEDSAGGWYDYNDMDSDSDFEDFGPLK FTPTSTGFSIQFP |
| 16 | The amino acid sequence of SEQ ID 276. The conserved cyclin and cyclin C-terminal domains are underlined and the cyclins signature is in bold. | MSNQHRRSSFSSSTTSSLAKRHASSSSSSLENAGEAFAA AAVPSHLARKRAPLGNLTNLKAGDGNSRSSSAPSTLVAN ATKLAKTRKGSSTSSSIMGLSGSALPRYASTKPSGVLPS VNPSIPRIEIAVDPNSCSMVVSPSRSDMQSVSLDESMST CESFKSPDVEYIDNEDVSAVDSIDRRTFSNLYISDAAAK TAVNICERDVLMEMETDEKIVNVDDNYSDPQLCATIACD IYQHLRASEAKRRPSTDFMDRVQKDITASMRAILIDWLV EVAEEYRLVPDTLYLTVNYIDRYLSGNVMNRQRLQLLGV ACMMIAAKYEEICAPQVEEFCYITDNTYFKEEVLQMESS VLNYLKFEMTAPTVKCFLRRFVRAAQGVNEVPSLQLECM ANYIAELSLLEYDNLCYAPSLVAASAIFLARFVITPSKR PWDPTLQHYTLYQPSDLGNCVKDLHRLCFNNHGSTLPAI REKYSQNKYRYVAKKYCPPSIPPEFFHNLVY |
| 17 | The amino acid sequence of SEQ ID 277. The conserved cyclin and cyclin C-terminal domains are underlined. | MNKENAVGTRSEAPTIRITRSRSRALGTSTGMLPSSRPS FKQEQKRTVRANAKRSASDENKGTMVGNASKQHKKRTVL NDVTNIFCENSYSNCLNAAEAQTSRQGRRWSMKKDRDVH QSGAVQIMQEDVQAQFVEESSKIKVAESMEITIPDKWAK RENSENSISMKDTVAESSRKPQEFICGEKSAALVQPSIV DIDSKLEDPQACTPYALDIYNYKRSTELERRPSTIYMET LQKDVTPNMRGILVDWLVEVSEEYKLVPDTLYLTVNLID RSLSQKFIEKQRLQLLGVTCMLIASKYEEICPPRVEEEC |

TABLE 11-continued

Annotated Peptide Sequences of the Present Invention.

| Entry | Sequence Description | Annotated Peptide Sequence |
|---|---|---|
|  |  | <u>FITDNTYTSLEVLKMESRVLNLLHFQLSVPTVKTFLRRF VQAAQVSSEVPSVELEYLANYLAELTLVEYSFLRFLPSL MAASAVLLARWTLNQSDNPWNLTLEHYTKYKASELKAAV LALEDLQLNTSGSTLNAIREKYRQQKVNYSLLIHSKANH EIL</u> |
| 18 | The amino acid sequence of SEQ ID 278. The conserved cyclin N- and c-terminal family domains are underlined end the cyclins signature is in bold. | MAGSDENNPGVVGGAHVQEGLRVGAGKMGAGNVQQRRAL SNINSNIIGAPPYPCAVNKRVLSEKNVNSENDLLNAAHR PITRQFAAQMAYKQQLRPEENKRTTQSVSNPSRSEDCAI LDVDDDRMADDFPVPMFVQHTEAMLEEIDRMEEVEMEDV AEEPVTDIDSGDRENQLAVVEYID<u>DLYMFYQKAEASSCV PPNYMDRQQDINERMRGILIDWLIEVHYKFELMDETLYL TVNLIDRFLAVQPVVKKKLQLVGVTAMLLACKYEEVSVP VVEDLILISDRAYSRKEVLEMERLMVNTLHFNMSVPTPY VFMRRFLKAAQSDRKLELLSFFIIELSLVEYDMLKFPPS LLAASAIYTALSTITRTRQWSTTCEWHTSYSEEQLLECA RLMVTFHQRAGSGKLTGVHRKYSTSKFGHAARTEPANFL LDFRL</u> |
| 19 | The amino acid sequence of SEQ ID 279. The conserved cyclin and cyclin C-terminal domains are underlined. | MASRPIVPVQARGEAAIGGGAGKAAIGGGAGKQQKKNGA AEGRNRKALGDIGNLVTVRGIEGRVQPHRPITRSFCAQL LANAQAAAAAENNKKQAVVNVNGAPSILDVPGAGKRAEP AAAAAAAVAKAAQRKVVKPKQKAEVIDLTSDSEERSRPR RSN<u>NIMSLRRRKERNHREGICPLSLRSSLLEARLVDWLI EIHNRFDLMPETLYLTINIIDRFLSVKAVPRRELQLLGM GALFTASKYEEIWAPEVNDLVCIADRAYSHEQVLANEKT ILGKLEWTLTVPTHYVFLVRFIRASLGDRKLENMVYFLA ELGVMNYATLTYCPSMVAASAVYAARCTLGLTPLWNDTL KLHTGFSESQLMDCARLLVGYHAKAKENKLQVVYKKYSS SQREGVALIPPAKALLCEGGGLSSSSSLASSS</u> |
| 20 | The amino acid sequence of SEQ ID 280. The conserved cyclin and cyclin C-terminal domains are underlined and the cyclins signature is in bold. | MGLPDENNAALSKPTNLQVGGLEIGGRKFGQEIRQTRRA LSVINQNLVGDRAYPCHVVNKRGNSKRDAVCGKDQVDPV HRPLTRKFAAQTASTQQHCIEEAKKPRTAVQERNEFGDC IFVDVEDCQPSSENQPVPMFLEIPESRLDDDMEEVEMED IVEEEEEEPIMDIDGRDKKNPLAVVDYI<u>EDIYANYRRTE NCSCVSANYMAQQADINEKMRSILIDWLIEVHDKFDLMH ETLFLTVNLIDRFLARQSVVRKKLQLVGLVAMLLACKYE EVSVPVVGDLILISDKAYTRKEVLEMESLMLNSLQFNMS VPTPYVMFRRFLKAAESDKKLEVLSFFLIELSLVEYEMV RFPPSLLAAAAIFTAQCTLYGFKQWTKTCEWHSNYTEDQ LLECARMMVGFHQKAATGKLTGVNRKYGTSKFGYTSKCE PANFLLGEMKNP</u> |
| 21 | The amino acid sequence of SEQ ID 281. The conserved cyclin and cyclin C-terminal domains are underlined and the cyclins signature is in bold. | MGLPDENNAALSKPTNLQVGGLEIGGRKFGQEIRQTRRA LSVINQNLVGDRAYPCHVVNKRGHSKRDAVCGKDQVDPV HRPLTRKFAAQTASTQQHCIEEAKKPRTAVQERNEFGDC IFVDVEDCQPSSENQPVPMFLEIPESRLDDDMEEVEMED IVEEEEEEPIMDIDGRDRKNPLAVVDYI<u>EDIYANYRRTE NCSCVSANYMAQQADINEKMRSILIDWLIEVHDKFDLWI ETLFLTVNLIDRFPLARQSVVRKKLQLVGLVAMLLACEYE EVSVPVVGDLILISDKAYTRKEVLEMEKLMLNSLQFNMS VPTPYVFNRRFLKAAESDKKLEVLSFFLIELSLVEYEMV KFPPSLLAAAAIFTAQCTLYGFKQWTKTCEWHSNYTEDQ LLECARNMVGFHQKAATGKLTGVHRKYGTSKFGYTSKCE PANFLLGEMKNP</u> |
| 22 | The amino acid sequence of SEQ ID 282. The conserved cyclin N- and C-terminal family domains are underlined. | MAMVQRQGHDPSSPQEQEDGPSSFLSDDALYCEEGRFEE DDGGGGQVDGIPLFPSQPADRQQDSPWADEDGEEKEEE EAELQSLFSKERGARPELAKDDGGAVAARREAV<u>EWMLMV RGVYGFSALTAVLAVDYLDRFLAGFRLQRDNRPWMTQLV AVACLALAAKVEETDVPLLVELQEVGDARYVFEAKTVQR MELLVLSTLGWEMHPVTPLSFVHHVARRLGASPHHGEFT HWAFLRRCERLLVAAVSDARSLKHLPSVLAAAAMLRVIE EVEPFRSSEYKAQLLSALHMSQEMVEDCCRFILGIAETA GDAVTSSLDSFLKRKRRCGHLSPRSPSGVIDASFSCDDE SNDSWATDPPSDPDDNDDLNPLPKKSRSSSPSSSPSSVP DRVLDLPFMNRIFEGIVNGSPI</u> |
| 23 | The amino acid sequence of SEQ ID 283. The conserved cyclin and cyclin C-terminal domains are underlined. | MEASYQPHHHGHLRQHDPSSSQQEEQVPFDALYCSEEHW GEEDEEEGLASDGLLSEERDHRLLSPRALLDQDLLWEDE <u>ELASLFSKEEPGGMRLNLENDPSLADARREAVEWIMRVN AHYAFSALTALLAVNYWDRFTCSFALQEDKPWMTQLSAV ACLSLAAKVEETQVPLLIDFQVEDSSPVFEAKNIQRMEL LVLSSLEWKMNPVTPLSFLDYMTRRLGLTGHLCWEFLRR</u> |

TABLE 11-continued

Annotated Peptide Sequences of the Present Invention.

| Entry | Sequence Description | Annotated Peptide Sequence |
|---|---|---|
| | | CENVLLSVISDCRFTCYLPSVIAASTMLHVINGLKPRLD VEDQTQLLGILAMGMDKIDACYKLIDDDHALRSQRYSHN KRKFGSVPGSPRGVMELCFSSDGSNDSWSVAASVSSSPE PHSKKSRAGEEAEDRLLRGLEGEEDDPASADIFSFPH |
| 24 | The amino acid sequence of SEQ ID 284. The conserved cyclin and cyclin C-terminal domains are underlined. | MALQEEDTRRHYPTAPPFSPDGLYCEDETFGEDLADNAC EYAGGGARDGLCEIKDPTLPPSLLGQDLFWED<u>GELASLV SRETGTHPCWDELISDGSVALARKDAVGWILRVHGHYGF RPLTAMLAVNYLDRFFLSRSYQRDRPWISQLVAVACLSV AAKVEETQVPILLDLQVANAKFVFESRTIQRMELLLMST LDWRMNSVTPISFFDHILRRFGLTTNLHRQFFWNCERLL LSVVADVRLASFLPSVVATAANLYVNKEIEPCICSEFLD QLLSLLKINEDRVNECYELILELSIDHPEILNYKHKRKR GSVPSSPSGVIDTSFSCDSSNDSWGVASSVSSSLEPRFK RSRFQDQQMGLPSVNVSSMGVLNSSY</u> |
| 25 | The amino acid sequence of SEQ ID 285. The conserved cyclin-dependent kinases regulatory subunit domain is underlined and the cyclin-dependent kinases regulatory subunits signature 1 is in bold. | <u>MGQIQYSEKYFDDTYEYRHVVLPPDVAKLLPKNRLLSEN EWRAIGVQQSRGWVHYAIHRPEPHIMLFRRPLNYQQQQE NQAQQNMLAK</u> |
| 26 | The amino acid sequence of SEQ ID 286. The conserved chromo domain is underlined and the MOZ/SAS-like protein domain is in bold/italics. | MGSIDPPKAEQNGTAAAAVADPGQKPGAGDAMPPPPPVW HSNGTAAEPDVATKRRRMSVLPLEVGTRVMCRWRDG<u>KYH PVKVIERRKLNPGDPNDYEYYVHYTEFNRRLDEWVKLEQ LDLNSVETVVDEKVEDKVTGLKMTRHQKRKIDETHVEGH EELDAASLREHEEFTKVKNIATIELGRYEIETWYFSPFP PEYNDCSKLYFCEFCLNFMKRKEQLQRHMKKCD</u> *LKHPPG DEIYRSGTLSMFEVDGKKNKVY GQNLCYLAKLFLDHKTL YYDVDLFLYVLCECDDRGCHM VGYFSKEKHSEESYNLA CILTLPPYQRKGYGKFLIAFSY ELSKKEGKVGTPERPLS DLGLLSYKGYWTRVLLDILKKH KANISIKELSDMTAIKA DDILNTLQSLDLIQYRKGQHVICAD*DPKVLDRHLKAA GRGGLEVDVSKLIWTPYREQG |
| 27 | The amino acid sequence of SEQ ID 292. The conserved histone deacetylase family domain is underlined. | MDTGGNSLPSGPDGVK<u>RKVCYFYDPEVGNYYLLQHMQVL KPVPARDRDLCRFHADDYVAELRSITPETQQDQLRQLKR FNVGEDCPVFDGLHSFCQTYAGGSVGGAVKLNHGLCDIA INWAGGLHHAKKCEASGFCYVNDIVLGILELLKQHERVL YVDIDIHHGDGVEEAFYTTDRVMTVSFHKFGDYFPGTGD IRDIGYGKGKYYSLNVPLDDGIDDESYHSLFKPIIGKVM EVFKPGAVVLQCGADSLSGDRLGCFNLSIKGHAECVRYM RSFNVPVLLLGGGGYTIRNVARCWCYETGVALGLEVDDK MPQHEYYEYFGPDYTLHVAPSNMENKNSRQLLEEIRSKL LENLSKLQHAPSVPFQERPPDTELPEADEDQEDPDERWD PDSDMDVDEDRKPLPSRVKRELIVEPEVKDQDSQKASID HGRGLDTTQEDNASIKVSDMNSMITDEQSVKMEQDNVNK PSEQIFPK</u> |
| 28 | The amino acid sequence of SEQ ID 293. The conserved histone deacetylase family domain is underlined. | MDTGGNSLPSGPDGVK<u>RKVCYFYDPEVGNYYYGQHPMK PHRIRMTHALLAHYGLLQHNQVLKPVPARDRDLCRFHAD DYVAFLRSITPETQQDQLRQLKRFNVGEDCPVFDGLHSF CQTYAGGSVGGAVKLNHGLCDIAINWAGGLHHAKKCEAS GFCYVNDIVLGILELLKQHERVLYVDIDIHHGDGVEEAF YTTDRVMTVSFHKFGDYFPGTGDIRDIGYGKGKYYSLNV PLDDGIDDESYHSLFKPIIGKVMEVFKPGAVVLQCGADS LSGDRLGCFNLSIKGHAECVRYMRSFNVPVLLLGGGGYT IRNVARCWCYETGVALGLEVDDKMPQHEYYEYFGPDYTL HVAPSNNENKNSPQLLEDIRSKLLENLSKLQHAPSVPFQ ERPPDTELPEADEDQEDPDERWDPQSDMDVDEQRKPLPS RVKRELIVEPEVKDQDSQKASIDHGRGLDTTQEDNASIK VSDMNSMITDEQSVKMEQDNVNRPSEQIFPK</u> |
| 29 | The amino acid sequence of SEQ ID 294. The conserved histone deacetylase domain is underlined. | MRPK<u>DRISYFYDGDVGSVYFGPNHPMKPHRLCMTHHLVL SYELHTKMEIYRPHKAYPAELAQEHSPDYVEFLHRITPD TQHLFPNDLAKYNLGEDCPVFENLFEFCQIYAGGTIDAA RRLNNQLCDIAINWAGGLHHAKKCEASGFCYINDLVLGI LELLRYHARVLYIDIDVHHGDGVEEAFYFTDRVMTVSPH KFGDMFFPGTGDVKEIGGKEGKFYAINVPLKDGIDDTSF TRLFKAIISKVVETYQPGAIVLQCGADSLAGDRLGCFNL SIDGHSECVRFVKKFNLPLLVTGGGGYTKENVARCWVVE</u> |

TABLE 11-continued

Annotated Peptide Sequences of the Present Invention.

| Entry | Sequence Description | Annotated Peptide Sequence |
|---|---|---|
| | | TGVLLDTELPNEIPENEYFKYFAPDYSLKIPRGNIVLEN LNSKSYLSAIKVQVLENLRNIQHAPSVQMQEVPPDFYIP DFDEDEQNPDERMDQHTQDKQIQRDDEYYDGDNDNDHNM DD |
| 30 | The amino acid sequence of SEQ ID 295. The conserved histone deacetylase family domain is underlined and the Zinc finger RanBP2-type profile is in bold. | MTVAEDFHVNNRSKMVSQATPESRLTGGEDDNSLHNQVD ELLCQELPERQVILEFEGTRPKPYFSDHNGGENSALGVR ATEQDLNSDVEAEEKQKEMTLEDMYKNDGTLYQDDEDQS DWEPVKRQVELMRWFCTNCTMVNVEDVFLCDICGEHRDS GILRHGFYASPFMQDVGAPSVEAEVQESREDHARSSPPS SSTVVGFQEKMLLHSEVEMKSHPHPERAORLQAIAASLA TAGIFPGRCRSLPVREITKEELQMVHSSEHVDAVEMTSH MFSSYFTPDTYANEHSARAARIAAGLCADLASTIISGRS KNGFALVRPPGHHAGIKHAMGFCLHNNAAVAALAAQGAG AKKVLIVDWQVHHGNGTQEIFQGNKSVLYISLHRHEGGN FYPGTGAAHEVGTMGAEGYCVNIPWSRRGVGDNDYVFAF HHIVLPIASAFAPDFTIISAGFDAARGDPLGCCDVTPAG YAQMTHMLSALSGGKLLVILEGGYNLRSISSSAVAVIKV LLGDSPISEIADAVPSKAGLRTVLEVLKIQRSYWPSLES IFWELQSQWGMFLVONRRKQIRKRRRVLVPIWWKWGRKS VLYHLLNGHLHVKTKR |
| 31 | The amino acid sequence of SEQ ID 296. The conserved histone deacetylase family domain is underlined. | MAAAPSSPPTNRVDVFWHDGMLSHDTGRGVFDTGSDPGF LDVLEKHPENPDRVRNMVSILKRGPISPFISWETATFAL ISQLLSFHSPEYINELVEADKNGGKVLCAGTFLNPGSWD AALLAAGNTLSAMKYVLDGKGRIAYALVRPPGHHAQPSQ ADGYCFLNNAGLAVRLALDSGCKRVVVVDIDVHYGNGTA EGFYQSSDVLTISLHINHGSWGPSHPQSGSVDELGEDEG YGYIINIPLPNGTGDRGYEYAVTELVVPAVESFKPEMVV LVVGQDSSAFDPNGRQCLTMDGYRAIGRTIRGLADRHSG GRILIVQEGGYHVTYSAYCLHATVEGILDLPDPLLADPI AYYPEDEAFPVKVVDSIKRYLVDKVPFLKEH |
| 32 | The amino acid sequence of SEQ ID 297. The conserved histone deacetylase family domain is underlined. | MVESSGGASLPSVGQDARKRRVSYFYEPTIGDYYYGQGH PMKPHRIRMAHNLIVHYYLHRRMEISRPFPAATTDIRRF HSEDYVTFISSVTPETVSDPAFSRQLKRFNVGEDCPVFD GIFGFCQASAGGSMGAAVKLNRGDSDIALNWAGGLHHAK KSEASGFCYVNDIVLGILELLKVHKRVLYVDIDVHHGDG VEEAFYTTDRVMTVSFHKFGDFFPGSGHIKDTGAGPGKN YALNVPLNDGIDDESFRGMFRPIIQKVMEVYQPDAVVLQ CGADSLSGDRLGCFNLSVKGHADCLRFLRSFNVPLMVLG GGGYTMRNVARCWCYETAVAVGVEPENDLPYNEYYEYFG PDYTLHVEPCSMENLNAPRDLERIRNNLLEQLSRIPHAP SVPFQMTPPITQEPEEAEEDMDERPKPRIWNGEDYESDA EEDKSQHRSSNADALHDENVEMRDSVGENSGDKTREDRS PS |
| 33 | The amino acid sequence of SEQ ID 299. The conserved cyclophilin-type peptidyl-prolyl cis-trans isomerase family domain is underlined. | MAAIISCHHYHSCCSSLIASKWVGARIPTSCFGRSSTQS NNAASVRQFVTRCSSSPSSRGQWQPHQNGEKGRSFSLRE CAISIALAVGLVTGVPSLDMSTGNAYAASPALPDLSVLI SGPPIKDPEALLRYALPINNKAIREVQKPLEDITDSLKV AGLRALDSVERHVRQASRVLKQGKNLIVSGLAESKKDHG VELLDKLEAGMDELQQIVEDGNRDAVAGKQRELLNYVGG VEEDMVDGEPYEVPEEYKNMPLLKGRAAVDMKVKVKDNP NLEECVFRIVLDGYNAPVTAGNFVDLVERHFYDGMEIQR ADGFVVQTGDPEGPAESFIDPSTEKPRTIPLEIDMDGEK APVYGATLEELGLYKAQTKLPFNAFGTMAMARDEFEDNS ASSQIFWLLKESELTPSNANILDGRYAVFGYVTENQDFL ADLKVGDVIESVQVVSGLDNLANPSYKIAG |
| 34 | The amino acid sequence of SEQ ID 300. The conserved FKBP-type peptidylprolyl isonerase domains are underlined. The FKBP-type peptidyl-prolyl cis-trans isomerase signature 1 is in bold and the FKBP-type peptidyl-prolyl cis-trans isonerase signature 2 is in bold/italics. | MAGEDFDIPPADEMNEDFDLPDDDDDAPVMKAGDEKEIG KQGLKRKLVKEGDAWETPDNGDEVEVHYTGTLLDGTQFD SSRDRGTPFKFTLGQGQVIKGWDQGIKTMKKGENAIFTI PPELAYGEAGSPPTIPPNATLQFDVELLSWTSVKDICKD GGIFKKILVEGEKWENPKDLDEVLVRYEFQLEDGTTIAR SDGVEFTVKEGHFCPAVAKAVKTMKKGEKVLLTVKPQYG FGEKGKPASGDEGAVPPNATLQITLELVSWKTVSEVTDD KKVIKKILKEGEGYERPNEGAVVEVKLIGKLQDGTVFVK KGHDDCEELFKFKIDEEQVVDGLDKAVMNMKKGEVALLT VAPEYAFGSSESKQDLAVVPPSSTVYYEVELVSFVKDKE SWDMNTEEKIEAAGKKKEEGNVIFKAGKYAKASKRYEKA VKYIEYDTSFSEDEKKQAKALKVACNLNDAACKLKLKDY NQAEKLCTKVLELDSRNVKALYRRAQAYIELSDLDLAEF DIKKALEIDPHNRDVKLEYKVLKEKVKEFNKKDAKFYGN MFAKMSKLEPVEKTAAKEPEPMSIDSKA |

TABLE 11-continued

Annotated Peptide Sequences of the Present Invention.

| Entry | Sequence Description | Annotated Peptide Sequence |
|---|---|---|
| 35 | The amino acid sequence of SEQ ID 301. The conserved cyclophilin-type peptidyl-prolyl cis-trans isomerase family domain is underlined and the cyclophilin-type peptidyl-prolyl cis-trans isomerase signature is in bold. | MSTVYVLEPPTKGKVVLNTTHGPLQVELWPKEAPRAVRN FVQLCLSGYYDNTIFHRIIKDFLVQGGDPTGSGTGGESI YGDAFSDEFHSRLRFKHRGLVACANAGSPHSNGSQFFIT LDRCDWLDRKNTIFGKITGDSIYNLSGLAEVETDKSDRP LDPPPKIISVEVLWNPFEDIVPRAPVRSLVPTVPDVQNK EPKKKAVKKLNLLSFGEEAEEEEKALVVVKQKIKSSHDV LDDPRLLKEHIPSKQVDSYDSKTARDVQSVREALSSKKQ ELQKESGAEFSNSFREIADDEDDDDDDASFDARMRRQIL QKRKELGDLPPKPKPKSRDGISARKERETSISRDKDDDD DDDQPRVEKLSLKKKGIGSEARGERMANADADLQLLNDA ERGRQLQKQKKHRLRGREDEVLTKLETFKASVFGKPLAS SAKVGDGDGDLSDWRSVKLKFAPEPGKDHMTRNEDPNDY VVVDPLLERGKEKFNRMQAKEKRRGREWAGKSLT |
| 36 | The amino acid sequence of SEQ ID 302. The conserved cyclophilin-type peptidyl-prolyl cis-trans isomerase family domain is underlined and the cyclophilin-type peptidyl-prolyl cis-trans isomerase signature is in bold. | MASAISMHSSGLLLLQGTNGKDVTEMGKAPASSRVANNQ QRKYGATCCVARGLTSRSHYASSLAFKQFSKTPSIKYDR MVEIKAMATDLGLQAKVTNKCFTDVEIGGEPAGRIVIGL FGDDVPKTVENFRALCTGEKGFGYKGCSFHRIIKDFMIQ GGDFTRGNGTGGKSIYGSTFEDENFALKHVGPGVLSMAN AGPSTNGSQFFICTVRTPWLDNRHVVFGQVVDGMDVVQK LESQETSRSDVPRQPCRIVNCGELPLDG |
| 37 | The amino acid sequence of SEQ ID 303. The conserved cyclophilin-type peptidyl-prolyl cis-trans isomerase signature is underlined. | MAASFTALSNVGSLSSPRNGSEIRRFRPSCNVAASVRPP PLKAGLSASSSSSFSGSLRLIPLSSSPQRKSRPCSVRAS AEAAAAQSKVTNKVYLDISIGNPVGKLVGRIVIGLYGDD VPQTAENFRALCTGEKGFGYKGSTV<u>HRVIKDFMIQGGDF DKGNGTGGKSIYGRTFKDENFKLSHVGPGVVSMANAGPN TNGSQFFICTVKTPWLDQRHVVFGQVLEGMDIVRLIESQ</u> ETDRGDRPRKRVVVSDCGELPVV |
| 38 | The amino acid sequence of SEQ ID 304. The conserved FKBP-type peptidyl-prolyl cis-trans isomerase signature is underlined and the FKBP-type peptidyl-prolyl cis-trans isomerase signature 2 is in bold. | <u>MAEAIDLTGDGGVMKTIVRRAKPDAVSPSETLPLVDVRY EGVLAETGEVFDSTHEDNTLFSFEIGKGS</u>VISAWDTALR TMKVGEVAKITCKPEYAYGSTGSPPDIPPDATLIFEVEL VACKPCKGFSVTSVTEDKARLEELKKQREIAAATKEEEK KRREEAKAAAAARVQAKLDAKKGHGKGKGKAK |
| 39 | The amino acid sequence of SEQ ID 305. The conserved cyclophilin-type peptidyl-prolyl cis-trans isomerase family domain is underlined and the cyclophilin-type peptidyl-prolyl cis-trans isomerase signature is in bold. | MGNPKVFFDMSIGGQPAGRIVMELYADVVPRTAENFRAL CTGEKGAGRSGKPLHYKGSSFHRVIPGFMCQGGDFTAGN GTGGESIYGSKFADENFVKKNTGPGVLSMANAGPGTNGS QFFVCTAKTEWLDGKHVVFGQIVDGMDVVKAIEKVGSSS GRTSKPVVVADCGQLS |
| 40 | The amino acid sequence of SEQ ID 306. The conserved cyclophilin-type peptidyl-prolyl cis-trans isomerase signature is underlined and the cyclophilin-type peptidyl-prolyl cis-trans isomerase signature is in bold. | MPNPKVFFDMTIGGAAAGRVVMELYADTTPRTAENFRAL CTGEKGVGRSKKPLHYKGSKFHRVIPSFMCQGGDFTAGN GTGGESIYGVKFADENFIKKHTGPGILSMANAGPGTNGS QFFICTTKTEWLDGKHVVFGKVVEGMEVVKAIEKVGSSS GRTSKPVVVADCGQLP |
| 41 | The amino acid sequence of SEQ ID 301. The conserved FKBP-type peptidyl-prolyl cis-trans isomerase signature is underlined and the FKBP-type peptidyl-prolyl cis-trans isomerase signature 2 is in bold. | MAEAIDLTGDGGVMKTIVRRAKPDAVS<u>PSETLPLVDVRY EGVLAETGEVFDSTHEDNTLFSFEIGRGS</u>VISAWDTALR TMKVGEVAKITCKPEYAYGSTGSPPDIPPDATLIFEVEL VACKPCKGFSVTSVTEDKARLEELKKQREIAAATKEEEK KRREEAKAAAAARVQAKLDAKKGHGKGKGKAK |
| 42 | The amino acid sequence of SEQ ID 308. The conserved cyclophilin-type peptidyl-prolyl cistrans isomerase signature is underlined and the cyclophil in-type peptidyl prolyl cis-trans isomerase signature is in bold. | MATARSFFLCALLLLATLYLAQAKKSEDLKEVTHKVYFD VEIAGKPAGRIVMGLYGKAVPKTAENFRALCTGEKGTGK SGKPLHYKGSSFHRIIPSFMLQGGDFTLGDGRGGESIYG EKFADENFKLKHTGPGLLSMANAGPDTNGSQFFITTVTT SWLDGRHVVFGKVLSGNDVVYKVEAEGRQSGTPKSKVVI ADSGELPL |
| 43 | The amino acid sequence of SEQ ID 309. The conserved cyclophilin-type peptidyl-prolyl cistrans isomerase family domain is | MMRREISVLLQPRFVLAFLALALVLLLVFAPPFSRQRGDQ VEEEPEITHRVYLDVDIDGQHLGRIVIGLYGEVVPRTVE NFRALCTGEKGKSANGKKLHYKGTPFHRIISGFMIQCGD VIYGDGKGYESIYGGTFADENFRIKHSHAGIISMVNSGP |

TABLE 11-continued

Annotated Peptide Sequences of the Present Invention.

| Entry | Sequence Description | Annotated Peptide Sequence |
|---|---|---|
| | underlined and the cyclophilin-type peptidyl-prolyl cis-trans isomerase signature is in bold. | DSNGSQFFITTVKASWLDGEHVVFGRVIQGHDTVYAIEG GAGTYNGKPRKKVIIADSGEIPKSKWDEER |
| 44 | The amino acid sequence of SEQ ID 310. The conserved cyclophilin-type peptidyl-prolyl cis-trans isomerase family domain is underlined and the cyclophilin-type peptidyl-prolyl cis-trans isomerase signature is in bold. | MWATAEGGPPEVTLETSMGSFTVELYFKHAPRTSRNFIE LSRRGYYDNVKFHRIIKDFIVQGGDPTGTGRGGESIYGK KFEDEIRPELKHTGAGILSMANAGPNTNGSQFFITLAPC PSLDGKHTIFGRVCRGMEIIKRLGSVQTDNNDRPIHDVR ILRTSVKD |
| 45 | The amino acid sequence of SEQ ID 311. The conserved cyclophilin-type peptidyl-prolyl cis-trans isomerase family domain is underlined and the cyclophilin-type peptidyl-prolyl cis-trans isomerase signature is in bold. | MSNP<u>KVFFDILIGKMKAGRVVMELFADVTPKTAENFRAL CTGEKGIGRSGKPLHYKGSTFHRIIPNFMCQGGDPTRGN GTGGESIYGMKFADENFKIKHTGLGVLSMANAGPDTNGS QFFICTEKTPWLDGKHVVFGKVIDGYNVVKEMESVGSDS GSTRETVAIEDCGQLSEN</u> |
| 46 | The amino acid sequence of SEQ ID 312. The conserved FKBP-type peptidylprolyl isomerase domains are underlined. The FKBP-type peptidyl-prolyl cis-trans isomerase signature 1 is in bold and the FKBP-type peptidyl-prolyl cis-trans isomerase signature 2 is in bold/italics. The TPR repeat is in italics. | MDDDFEFPASSNVENDDDDGNDNDDNGGDVPEEEDPVAS PAVLKVGEEREIGKAGFKKKLVKEGEGWETPSSGDEVEV HYTGTLLDGTKFDSSRDRGTPFKFKLGRGQ*VIKGWDEGI KTMKKGENAIFTIPPELAYG*ESGSPPTIPPNATLQFDVE LLSWSSVKDICKDGGILKKVLVEGEKWDNPKDLDEVFVK YEASLEDGTLISKSDGVEFTVGDGYFCAALAKAVKTMKK GEKVLLTVNPQYAFGETGRPASGDEAAVPPDASLQIMLE LVSWKTVSDVTKDKKVLKKTLKEGEGYERPNDGAAVQVR LCGKLQDGTVFVKDDEEPPEFKIDEEQ*VIDGLDRAVKN MKKGEVALVTIQPEYAFG*PTESQQDLAVVPANSTVYYEV ELLSFVKEKESWEMNNQEKIEAAARKKEEGNAAFKAGKY VRASKRYEKAVRFIEYDSSFSDEEKQQAKTLKNTCNLND AACKLKLKDFKEAEKLCTKVLEGDGKNVKALYRRAQAYI QLVDLDLAEQDIKKALEIDPNNRDVKLEYKILKEKVREY NKRDAQFYGNMFAKMNKLEHSRTAGMGAKHEAAPMTIDS KA |
| 47 | The amino acid sequence of SEQ ID 313. The conserved cyclophilin-type peptidyl-prolyl cis-trans isomerase family domain is underlined and the cyclophilin-type peptidyl-prolyl cis-trans isomerase signature is in bold. The TPR repeat is in bold/italics. | MAKP<u>RCFMDISIGGELEGRIVGELYTDVAPKTAENFRAL CTGEKGIGPHTGAPLHYKCVPFHRVIKGFMVQGGDISAG DGTGGESIYGLKFEDENFDLKHERKGNLSMANSGPNTNG SQFFITTTRTSHLDGKHVVFGRVVKGNGVVRSVEHVTTA AGDCPTVDVVIADCGEI</u>PAGADDGIRNFFKDGDTYPDWP ADLDESPAELSWWMDAVDSIKAFGNGSYKKQDYKNALRK YRKALRYLDICWEKEGIDEVESSSLRKTKSQIFTNSSAC KLKLCDLKGALLDAEFAVRDGENN*AKAYFRQGQAHMELN DIDAAAESFSKALELEPND*VGIKKELNAAKKKIFERREQ EKRAYRKNFL |
| 48 | The amino acid sequence of SEQ ID 314. The conserved cyclophilin-type peptidyl-prolyl cis-trans isomerase signature is underlined and the cyclophilin-type peptidyl-prolyl cis-trans isomerase signature is in bold. | MTKRKNPLVFLDVSIDGDPVERIVIELFADTVPRTAENF RSLCTGEKGVGKTTGKPLHYKGSYFHRIIKGFMAQGGDF SNGNGTGGESIYGGKFADENFKLAHDGPGLLSMANGGPN TNGSQFFIIFKRQPHLDGKHVVFGKVMRGMEVVKKIEQV GSANGKPLQPVKIVDCGETSETGTQDAVVEEKSKSATLK AKKKRSARDSSSESRGKRRQRKSRKERTRKRRRYSSSDS YSSESSSDSDSESYSSDTESESKSHSESSVSDSSSSDGRR RKRKSTKREKLRRQRGKDSRGEQKSARYDKKSRHKSADS SSDSESESSSRSRSRDDKKKSSRRESARSVSKLKDAEAN SPENLESPRDREIKKVEDNSSHEEGEFSPKNDVQHNGHG TDAKFGKYDDQRPRSDGSKKSSGSNRDSPKRLANSVPQG SPSSSPAHKASEPSSSIRARNPSRSPAPDGNSKRIRKGR GFTERFSYARRYRTPSPEDVTYRPYHYGRRNFEDRRNDR YSNYRSYSERSPHRRYRSPPRGRSPPRYQRRRSRSRSVS RSPGGNKGRYRGRDQSRSRSRSRSPRRGSSPANKQLP LSERLKSRLGTRVDEHSPRRRRSSSRSEDSSRSRSPDEV PDKHEGKAAPVSPARSRSSSPSGRGLVSYGDASPDSGIN |
| 49 | The amino acid sequence of SEQ ID 315. The conserved cyclophilin-type peptidyl-prolyl cis-trans isomerase signature is underlined. The CCHC type zinc finger is in bold and the RNA-binding region RNP-1 (RNA recognition motif) is in bold/italics. | MSVLLVTSLGDIVVDLHADRCPLTCKNFLKLCRIKYYNG CVFHTVQKDFTAQTGDPTGTGTGGDSVYKFLYGDQARFF MDEIHLDLKHSKTGTVAMASGGENLNASQFYFTLRDDLD YLDGKHTVFGEVAEGLETLTRINEAYVDEKGRPYKNIRI RHTYILDDPFDDPPQLAELIPDASPEGKPKDEVVDDVRL EDDWVPLDEQLGPAQLEEAIRAKEAHSRAVVLESIGDIP DAEIKPPDNV *LFVVKLNPVTEDEDLHTIFSRFGTVVSAD VIRDFKTGDSLCYAFIEFENKDSCEQAYFKMDNALIDDR RIKV*DFSQSVAKLWSQFKRKDSQAAKGKGCFKCGAPDHM |

TABLE 11-continued

Annotated Peptide Sequences of the Present Invention.

| Entry | Sequence Description | Annotated Peptide Sequence |
|---|---|---|
| | | APECPGSSTRQPLSKYILKEDNAQRGGDDSRYEMVFDED APESPSHGKKRRGRDDRDDRHKNSRQSVEETKFNDREGG HSVDKHRQSERSKHREDEMSRDSKASEAGRRRIDRDFPE EERDGEKYTESHRDRDGKRGDYRDYRKGRADVQTHGDRR GDENYRRKSAAYDDGHEGAGAARRKDSNDDHHAYRRGYG DSRKGTRDEDDDGRGRRDDPSYRSSGHKDSSNGGREEQ KYRSGETDGKSHPERSHRGDRRR |
| 50 | The amino acid sequence of SEQ ID 316. The conserved cyclophilin-type peptidyl-prolyl cis-trans isomerase signature is underlined. | MRPFNGGSSIACLVLVIAAGALAESQGPHLGSA<u>RVVFQT NYGDIEFGFFPGVAPRTVDHIFRLVRLGCYNTNHFFRVD KGFVAQVADVANGRTAPMNDEQRTEAEKTIVGEFSNVKH VRGILSMGRYDDPDSAQSSFSILLGDAPHLDGKYAIFGR VTKGDETLKKLEQLPTRREGMFVMPTERITILSSYYYDT GAESCEEENSTLRRRLAASAVEVERQRNKCFP</u> |
| 51 | The amino acid sequence of SEQ ID 317. The conserved cyclophilin-type peptidyl-prolyl cis-trans isomerase signature is underlined and the cyclophilin-type peptidyl-prolyl cis-trans isomerase signature is in bold. | MPNP<u>KVFFDMQVGGAPAGRIVMELYADVVPKTAENFRAL CTGEKGTGRSGKPLHFKCSSFHRVIPGFMCQGGDFTRGN GTGGESIYGEKFADENFVKKHTGPGILSMANAGPNTNGS QFFICTAQTSWLDGKHVVFGQVVEGLEVVRDIEKVGSGS GRTSKPVVIADSGQLA</u> |
| 52 | The amino acid sequence of SEQ ID 318. The conserved FKBP-type peptidyl-prolyl cis-trans isomerase signature is underlined and the FKBP-type peptidyl-prolyl cis-trans isomerase signature 2 is in bold. | MRFTSITSAIALFAAAASALDKPLDIKVDKAV<u>ECSRKTK AGDKIQVHYRGTLEADGSEFDASYRRGQPLSFHVGKGQV IKGWDQGLLDMCPGEKRTLTIQPDWGYGSRGMGPIPANS VLIFETELVEIAGVAREEL</u> |
| 53 | The amino acid sequence of SEQ ID 319. The conserved cyclophilin-type peptidyl-prolyl cis-trans isomerase signature is underlined and The cyclophilin-type peptidyl-prolyl cis-trans isomerase signature 2 is in bold. | MGNP<u>KVFFDMSIGGQPAGRIVMELYADVVPRTAENFRAL CTGEKGAGRSGKPLHYKGSSFHRVIPGFMCQGGDFTAGN GTGGESIYGSKFADENFVKKHTGPGVLSMANAGPGTNGS QFFVCTAKTEWLDGKHVVFGQIVDGMDVVKAIEKVGSSS GRTSKPVVVADCGQLS</u> |
| 54 | The amino acid sequence of SEQ ID 320. The conserved FKBP-type peptidyl-prolyl cis-trans isomerase signature is underlined and the Cyclophilin-type peptidyl-prolyl cis-trans isomerase signature is in bold. | MAVATRSRWVAMSVAWILVLFGTLALIQNRLSDTGASSD PKLVHRKVGEEKKKPDDLEEVTHK<u>VFFDVEIGGKPAGRI VMGLFGKTVPKTVENFRALCTGEKGIGKSGKPLNYKGSQ FHRIIPKFHIQGGDFTLGDGRGGESIYGNKFSDENFKLK HTDAGRLSMTNAGPDTNGSQFFITTVTTSWLDGRHVVFG KVLSGMDVVHKIEAEGGQSGQPKSIVVISDSGELDL</u> |
| 55 | The amino acid sequence of SEQ ID 321. The conserved cyclophilin-type peptidyl-prolyl cis-trans isomerase domain is underlined | <u>MAVTLHTNLGDIKCEIFCDEVPKAAEHNARGILSMANSG PNTNGSQFFIAYAKQPHLNGLYTIFGRVIHGFEVLDIME KTQTGPGDRPLAEIRLNRVTIHANPLAG</u> |
| 56 | The amino acid sequence of SEQ ID 322. The conserved FKBP-type peptidyl-prolyl cistrans isomerase signature is underlined and the Cyclophilin-type peptidyl-prolyl cis-trans isomerase signature is in bold. | MAVATRSRWVAMSVAWILVLFGTLALIQNRLSDTGASSD PKLVHRKVGEEKKKPDDLEEVTHK<u>VFFDVEIGGKPAGRI VMGLFGKTVPKTVENFRALCTGEKGIGKSGKPLNYKGSQ FHRIIPKFMIQGGDFTLGDGRGGESIYGNRFSDENFKLK HTDAGRLSMANAGPDTNGSQFFITTVTTSWLDGRHVVFG KVLSGMDVVHKIEAEGGQSGQPKSIVVISDSGELDL</u> |
| 57 | The amino acid sequence of SEQ ID 323. The conserved cyclophilin-type peptidyl-prolyl cis-trans isomerase signature is underlined andThe cyclophilin-type peptidyl-prolyl cis-trans isomerase signature 2 is in bold. | MGNP<u>KVFFDMSIGGQPAGRIVMELYADVVPRTAENFRAL CTGEKGAGRSGKPLHYKGSSFHRVIPGEHCQGGDFTAGN GTGGESIYGSKFADENFVKKNTGPGVLSMANAGPGTNGS QFFVCTAKTEWLDGKHVVFGQIVDGMDVVKAIEKVGSSS GRTSKPVVVADCGQLS</u> |
| 58 | The amino acid sequence of SEQ ID 324. The conserved A-box of the Retinoblastoma-associated protein is underlined and the B-box of the Retinoblastoma-associated protein is in bold. | MSPVAANAMEEAA<u>EPEVPAPVTPSRDDADTDAAVSRFLG FCRSKLGLAEGNCVQSSTLLRKTAHVLRSSGTVIGTGTA EEAERYWFAFVLYTVRRVGERKAEDEQNGSDETEVPLSR ILKASVLNLIDFFKEIPQFVIKAGAIVSGIYGANWDSRL EAREMQTNYVELCILCKFYKRICGEFFILNDAKDDMKSA DSSTSDPVIMYQPFGWLLFLALRIHALSRFKDLVSSTNA LVSVLAILIIHLPTRFRKFSISDSSQLVKRSEKGVDLVG</u> |

TABLE 11-continued

Annotated Peptide Sequences of the Present Invention.

| Entry | Sequence Description | Annotated Peptide Sequence |
|---|---|---|
|  |  | SLAYRYDTSEDEIKRTLEKANNVIAEILGITPPPASECK AENLENVDTDGLIYFGNLMEETSLSSILSTLEKIYEDAT RNDSEFDERVFINDDDSLLVSGSLSGAAINLTGAKRKYD SFASPAKTITRPLSPSRSPASHINGIIGGTNLRITATPV ATAMTTAKWLRTFVSPLPSKPSTDLQGFLASCDRDVTSD VIRRANIILEAIFPNSPIGERTVTGGLQNANLMDNMWAE QRRLEALRLYYRVLEAMCRAEAQILHSNNLTSLLTNERF HRCMLACSAELVLATHRTVTMLFPAVLERTGITAPDLSK VIESFVRHEETLPRELRRHLNTLEERLLENMVWERGSSM YNSLVVARPALAPEINRLGLLPEPMPSLDAIALLINFSS SGLPQSPVQKHEASPGQNGDIRSPKRISTEYRSVLVERN FTSPVKDRLLALSNIKSKLPPPPLQSAFASPTRPHPGGG <u>GETCAETAIHIFFSKITRLAAVRINANLERLQLSQQIKE</u> <u>GVYCLFQQILSQRTNLFFNRHIDQVILCCFYGVAKINQI</u> <u>NLTFREIIYNYRKQPQCKPQVFRNVEVDWSTRRNGKAGN</u> <u>EHVDIISFYNEIFIPSVKPLLVELGPTGATTRTNRTSEV</u> GNKNDAQCPGSPKISSFPTLPDMSPKKVSASHNVYVSPL RSSKNDASISHSSRSYYACVGESTHAYQSPSKDLVAINS RLNGNRKVRGTLNFDDVDAGLVSDSMVANSLYLQNGSSM SSSTAKSSEK |
| 59 | The amino acid sequence of SEQ ID 325. The conserved G-protein beta WD-40 repeat domains are underlined. | MRPILMKGHERPLTFLKYNREGDLLFSCAKDHTPTVWFA DNGE<u>RLGTYRGHNGAVWCCDVSRDSMRLITGSADTTAKL</u> <u>WS</u>VQNGTQLFTFNFDSPARSVDFSIGDRLAVITTDPFME LPSAIHVRRIARDPADQASESVLVLRGHQGRIARAVWGP LNKTIISAGEDAVIRIWDSETGRLL<u>RESDKETGHRKAVT</u> <u>SLMKSVDGSHFVTGSQDKSAKLWD</u>IRTLTLIKTYVTERP VNAVTMSPLLDHVVLGGGQDASAVTHTDHRAGKFEAKFF DKILQEEIGGVKGHFGPINALAFNPDGKSFSSGGEDGYV RLHHFDPDYFNIKI |
| 60 | The amino acid sequence of SEQ ID 326. The conserved G-protein beta domain is underlined and the WD-40 repeat domains are in bold | MDKKRTVVPLVCHGHSRPVVDLFYSPITPDGFFLISASK DSSPMLRNGETGDWIGTPEGHKCAVWSCCLDTNALRAAS GSADFSAKLWDALSGDELHSFEHKHIVRSCAFSEDTHLL LTGGVEKILPIFDLNRPDAPPREVDNSPGSIRTVAWLHS DQTILSSCTDIGGVRLWDVRSGKIVQTLETKSPVTSSEV SQDGRYITTADCSTVKFWDANHFGLVKSYNMPCNIESAS LEPKLGNKFIAGGEDNWVHIFDFHTGEEIGCNKGHHGPV HCVRFSPGGESYASCSEDGTIPIWQTGPANNVEGDANPS NGPVTGKAKVGADEVTRKVEDLQIGKEGRDWREG |
| 61 | The amino acid sequence of SEQ ID 327. The conserved G-protein beta WD-40 repeat domains are underlined. | MAEGLILKGTMRAHTDMVTAIAIPIDNSDMVVTSSRDKS <u>IILWHLTKEEKVYGVPRRRLTGHSHFVQDVVLSSDGQFA</u> <u>LSGSWDGELRLWDLATGVSARRFVGHTKDVLSVAFSIDN</u> <u>RQIVSASRDRTIKLWNTLGECKYTIQEGEAHTDWVSCVR</u> <u>FSPNTLQPTIVSASWDRTIKVWNLTNCKLRNTLAGHNGY</u> <u>VNTVAVSPDGSLCASGGKDGVILLWDLAEGKRLYNLEAG</u> <u>AIIHSLCFSPNRYWLCAATENSIKIWDLESKSIVEDLRV</u> <u>DLKNEADKTDGTTTAASNKKVIYCTSLNWSADGSTLFSG</u> YNDGVIRVWGTGRY |
| 62 | The amino acid sequence of SEQ ID 328. The conserved G-protein beta WD-40 repeat domains are underlined. | MAEGLHLKGTMKAHTDMVTAIAVPIDNADMIVTSSRDKS IILWHLTKEDK<u>VYGVPRRRLTGHSHFVQDVVLSSDGQFA</u> <u>LSGSWDGELRLWDLATGVSARRFVGHTKDVLSVAFSIDN</u> <u>RQIVSASRDRTIKLWNTLGECKYTIQEGEAHNDWVSCVR</u> <u>FSPNTLQPTIVSASWDRTVKVWNLTNCKLRNTLQGHSGY</u> <u>VNTVAVSPDGSLCASGGKDGVILLWDLAEGKKLYSLEAG</u> <u>AIIHSLCFSPNRYWLCAATENSIKIWDLESKSIVEDLRV</u> <u>DLKNEADMSDGTTGAMSSNKKVIYCTSLNWSADGSTLFS</u> GYNDGVIRVWGIGRY |
| 63 | The amino acid sequence of SEQ ID 329. The conserved G-protein beta WD-40 repeat domains are underlined and the Trp-Asp (WD) repeats signature is in bold. | MAEGLHLKGTMKAHTDMVTAIAVPIDNADMIVTSSRDKS <u>IILWHLTKEDKVYGVPRRRLTGHSHFVQDVVLSSDGQFA</u> <u>LSGSWDGELRLWDLATGVSARRFVGHTKDVLSVAFSIDN</u> <u>RQ</u>IVSASRDRTIKLWNT<u>LGECKYTIQEGEAHNDWVSCVR</u> <u>FSPNTLQPT</u>IVSASWDRTVKVWNL<u>TNCKLRNTLQGHSGY</u> <u>VNTVAVSPDGSLCASGGKDGVILLWDLAEGKKLYSLEAG</u> <u>AIIHSLCFSPNRYWLCAATENSIRIWDLESKSIVEDLRV</u> <u>DLKNEADMSDGTTGAMSSNKKVIYCTSLNWSADGSTLFS</u> GYNDGVIRVWGIGRY |
| 64 | The amino acid sequence of SEQ ID 330. The conserved G-protein beta WD-40 repeat domains are underlined. | MSGVPAPPFATTTPENGTMSSNSPAFHRDSDDDDDQGEV FLDDSDIIHEVAVDDEDLPDADDEADEAEEADD<u>SLHIFT</u> <u>GHNGEVYSLACSPTDATLVATGAGDDKGFLWRIGHGDWA</u> <u>VELQGHKDSISSLAFSLDGQLLASGSLDGVIQIWDVPSG</u> |

TABLE 11-continued

Annotated Peptide Sequences of the Present Invention.

| Entry | Sequence Description | Annotated Peptide Sequence |
|---|---|---|
| | | NLKGTLDGPGGGIEWIRWHPKGHIILAGSEDSTVWMWNA DKMAYLNMFSGHGNSVTCGDFTPDGKTICTGSDDATLRI WNPKSGENIHVVKGHPYHAEGLTSMAISSDSGLAITGAK DGSVRIVNISSGRVVSSLDAHADSVEFVGLALSSPWAAT GSLDQKLIIWDLQHSSPRATCDHEDGVTCLSWVGASRFL ASGCVDGKVRVWDSLSGDCVRTFHGHSDAIQSLSVSANE EFLVSVSIDGTARVFEIAEFH |
| 65 | The amino acid sequence of SEQ ID 331. The conserved G-protein beta WD-40 repeat domains are underlined. | MGTSQHQLSSCLQLLPRRGNKNLIFRRTMASGGAAAVA PPPGYKPYRHLKTLTGHVAAVSCVKFSNDGTLLASASLD KTLIIWSSAALSLLHRLVGHSEGVSDLAWSSDSHYICSA SDDRTLRIWSSRSPFDCLKTLRGHTDFVFCVNFNPQSSL IVSGSFDETIRIWEVKTGRCLNVIRAHSMPVTSVHFNRD GSLIVSGSHDGSCKIWDTKNGACLKTLIDDTVPAVSFAK FSPNGKFILVATLNDTLKLWNYATGKFLKIYTGHKNSVY CLTSTFSVTNGKYIVSGSEDRCICIWDLQGKNLIQKLEG HSDTVISVTCHPSENKIASAGLDSDRTVRIWLQDA |
| 66 | The amino acid sequence of SEQ ID 332. The conserved G-protein beta WD-40 repeat domains are underlined. | MPSQKIETGHQDIVHDVAMDYYGKRVATASSDTTIKIIG VSNSSGSQHLASLSGHKGPVWQVAWAHPKFGSILASCSY DGQVILWKEGNQNDWAQAHVFNDHKSSVNSIAWAPHELG LCLACGSSDGNISVFTARPDGGWDTTRIEQAHPVGVTSV SWAPSMAPGALVGSGLLDPVQKLASGGCDNTVKVWKLYN GTWKMDCFPALQMHSDWVRDVAWAPNLGLPKSTIASASQ DGTVVIWTVAKEGEQWQGKVLKDFKTPVWRVSWSLTGNL LAVADGNNNVTLWNEAVDGEWQQVTTVEP |
| 67 | The amino acid sequence of SEQ ID 333. The conserved G-protein beta WD-40 repeat domains are underlined and the Trp-Asp (WD) repeats signature is in bold. | MKIAGLKSVENAHDESVWAAAWVPATESRPALLLTGSLD ETVKLWRPDELALERTNAGHFLGVVSVAAHPSGVIAASA SIDSFVRVFDVDTNATIATLEAPPSEVWQMQFDPKGTTL AVAGGGSASIKLWDTATWELNATLSIPRPEQPKPSEKGN KKFVLSVAWSPDGRRLACGSMDGTISIFDVARAKFLHHL EGHFMPVRSLVFSPVEPRLLFSASDDAHVHMYDSEGRSL VGSMSGHASWVLSVDVSPDGAALATGSSDRTVRLWDLSM RAAVQTMSNHSDQVWGVAFRPMAGAGVRAGGRLASVSDQ KSISLYDYS |
| 68 | The amino acid sequence of SEQ ID 334. The conserved G-protein beta WD-40 repeat domains are underlined and the Trp-Asp (WD) repeats signature is in bold. | MEIDLGNLAFDVDFHPSEQLVASGLITGDLLLYRYGDGS SPEKLLEVRAHGESCRAVRFINDGKAILTGSPDCSILAT DVETGSVVARVENAHEAAVNRLVNLTESTIATGDDNGCI KVWDTRQRSCCNTFSAHEDFISDMTFASDSMKLVVTSGD GTLSVCNLRSNKVQTRSEFSEDELLSVVIMKNGRKVVCG TQSGTLLLYSWGFFKDCSDRFVDLSPSSVDALLKLDEDR IIAGTENGLISLIGILPNRIIQPIAEHSDHPIERLAFSH DKKFLGSISHDQTLKLWDLNDILGSEDSPSSQAAIDDSD SDEMOVDANPPDSSKGNKKKHSGKGNDVGNANNFFADLG D |
| 69 | The amino acid sequence of SEQ ID 335. The conserved G-protein beta WD-40 repeat domains are underlined and the Trp-Asp (WD) repeats signature is in bold. | MSQQPSVILATASYDHTIRFWEAKSGRCYRTIQYPDSQV NRLEITPHKRYLAVAGNPSIRLFDVNSNTPQPVMSFDSH TNNVMAVGFQYDGNWMYSGSEDGTVRIWDLRARGCQREY ESRGAVNTVVLHPNQTELISGDQNGNIRVWDLTANSCSC ELVPEVDTAVRSLTVMWDGSLVVAANNNGTCYVWRLLRG SQTMTNFEPLHKLQAHNGYILKCLLSPEFCEPHRYLATA SSDHTVKIWNVEGFTLEKTLIGHQRWVWDCVFSVDGAYL ITASSDTTARLWSMSTGQDIRVYQGHHKATTCCALHDGA EGSPG |
| 70 | The amino acid sequence of SEQ ID 336. The conserved G-protein beta WD-40 repeat domains are underlined. | MEDANDMEVEVEVEAEEHSPSSSNPSGSSFRRFGLKNSI QTNFGSDYVFEITPKFDWSLMGVSLSSNAVKLYSPTTGQ YCGECRGHSDTVNGISFSGPSSPHVLHSCSSDGTIRAWD TRSFKEVSCISAGPSQEIFSFSFGGSSDSLLSAGCKSQI LFWDWRNRKQVACLEDSHVDDVTQVCFVPHHQNKLISAS VDGLICIFDTAGDINDDEHMESVINVGTSIGKVGIFGQT FEKLWCLTHIETLSVWDWKEGTNEANFEDARKLASDSWS LDHIDYFVDCHSAEEGEGLWVIGGTNAGTLGYFPVKYKG GAAIGSPEAVLGGGHSDVVRSVLPMSGMAGTTSKTRGIF GWTGGEDGRLCCWLSDDSSATSRSWMSSNLVLKSSRSHR KKNRHQPY |
| 71 | The amino acid sequence of SEQ ID 337. The conserved G-protein beta domain is underlined and the WD-40 repeat domains are in bold | MSQHQEYPMEYAADDYDVGEVEDDMYFHERVMGDSDTDE DEEYDHLDNKITDTSAADARRGKDIQGIPWERLSVTREK YRRTRIEQYKNYENVPQSGESSEKDCKPTRKGGNYYEFW RNTRSVKSTILHFQLRNLVWSTTKHDVYLMSHFSIIHWS SLTCKKTEVLDVYGHVAPREKHPGSLLEGFTQTQVSTLA |

TABLE 11-continued

Annotated Peptide Sequences of the Present Invention.

| Entry | Sequence Description | Annotated Peptide Sequence |
|---|---|---|
| | | VRDKLLIAGGFQGELICKNLDRPGVSYCCRTTYDDNAIT NAVEIYDYPSGAVHFMASNNDCGVRDFDMEKFELSRHFT FPWPVNHTSLSPDGKLLVIVGDNPEGIVVDSQRGKTIRP LQGHLDFSFASAWHPDGHIFATGNQDKTCRIWDIRNLSK SVAVLKGNLGAIRSIRFTSDGRFMANAEPADFVHVYDVK SGYEKEQEIDFFGEISGVSFSPDTESLFVGVWDRTYGSL LQYNRCRNYSYLDSM |
| 72 | The amino acid sequence of SEQ ID 338. The conserved G-protein beta WD-40 repeat domains are underlined. | MGASSDPNPDVSDEHQKRSEIYTYEAPWHIYANNWSVRR DKKYRLAIASLLDHPAAAAAVPNRVEIVQLDDSTGEIRA DPNLSFDHPYPATKAAFVPDKDCQRADLLATSSDFLRIW RIADDSSRVDLRSFLNGNKNSEFCRPLTSFDWNEAEPKR IGTSSIDTTCTIWDIERETVDTQLIAHDKEVYDIAWGGV SVFASVSADGSVRVFDLRDKEHSTIIYESSEPDTPLVRL GWNKQDPRYMATIIMDSAKVVVLDIRYPTMPVVELQRRQ ASVNAIAWAPHSSCHICTAGDDSQALIWDLSSMAQPVEG GLDPILAYTAGAEIEQLQWSSSQPDWVAIAFSLKLQ |
| 73 | The amino acid sequence of SEQ ID 339. The conserved G-protein beta WD-40 repeat domains are underlined. | MRGGGGGGDATGWDEDAYRESVLKEREVQTRTVFRAAFA PSPSPSPSPDAVVVASSDGSVASYSISACLSDRRLQSLR FADAKSQNVLEAEPACFLQGHDGPAYDVKFYGEGEDSLL LSCGDDGRIRGWMWRDITSSEAHDHSQGNSAKPVLDLVN PQSRGPWGALSPIPENNALAVDVKRGSIYAAAGDSCAYC WDVECGKIKTVFKGHSDYLHCIAARNSSSQIITGSEDGT ARIWDCRSGKCVQVIDPDKDHKKGFFASVSCLALDASES WLVCGRGRDLSVWSISASQCIAKISTNAPAQDVLFDDNQ ILLVGAEPLISRLDMNGAVLSQIHCAPQSVFSVSLHQSG VTAVGGYGGLVDVISQFGSHLCTFRCKCI |
| 74 | The amino acid sequence of SEQ ID 340. The conserved G-protein beta WD-40 repeat domains are underlined. | MEAPIIDPLQGDFPEVIEEEYLEHGIMKCIAFNRRGTLLA AGCTDGSCIIWDFETRGVAKELRDKECTAAITSVCWSKY GHRILVSASDKSLILWDVLSGEKIAHTTLQHTVLQACLH PGSSTPSICLACPFSSAPMIVDLNTGSTTALPVLTADVS NGATPLSRNKTSDTSVTYSPCNACFNKHGDLVYAGTSKG EILIIDHKNVRVCAIVLVSGGAVIKNVVFSRNGQYMLTN SMDRLIRIYKNLLPPKDGLKNLDELNESFNESDDVEKLK AIGSKCLELLHEFQDSITRVQWKAPCFSGDGEWVIGGAA SRGEHKIYIWDRAGHLVKILEGPKEALMDLAWHPVHPII ISVSLTGLVYIWAKDYTENWSAFAPDFKELEENEEYVER EDEFQLVPETEEVKGLDVHEDDEVDVLTVERDSVFSDSD MSQEELCFLPAVPCLDIPEQQDKCVGSCSKLPDGNHSGS PLSVEAGQNGNASNHNSSPLEPMENSTADDTDGVRLKRK RKPSEKGLELQAEKVKEPVKPLKSSGRLSKTHKPVIDPD SSNGVYGDDGSD |
| 75 | The amino acid sequence of SEQ ID 341. The conserved G-protein beta WD-40 repeat domains are underlined. | MRGVSWPEDGNNPSTSSSSQRNQQQAHAPRAVSGHAASH PSASNIFKLLVQREVSPRSKHSSKKLWREASKCQPYPFQ QSCEAVRDVRQGLISWVESASLRHLSAKYCPLVPPPRST IAAAFSPDGKILASTHGDHTVKLIDSQTGSCLKVLRGHR RTPWVVRFHPLYPEILASGSLDHEVRLWDANTAECIGSR NFYRPIASIAFHARGELLAVASGHKLYIWHYNRRGETSS PTIVLRTQRSLRAVHFHPHAAPFLLTAEVNDLDSADSAH TLATSPGYLHYPPPTVYFADAHSHERSRLADELPLNPLP LLMWPSFTRDDGRVPLQRIDGDVGLNGQQRVDSSSSVRL WTYSTPSGQYELLLSPVESGNSPSMPEETGNNAFSSAVE AEVSQSAMDTVEDHEVQPEERNTQFFSFSDPRFWELPLL HGWLVGQTQAGPRSVRQSSPGDIETQSAFGEVASVSPIT SGVMPVSMDPSRFGGRSGSRYRSPGSRGVHVTGPNNDGP RDENDPQSVVSKLRSELAASLAAAASTELPCTVKLRIWP HDVKDPCAQLDLESCRLTIPHAVLCSEMGAHFSPCGRFL AACVACVLPHLESDPGLHGQVNQDVTGVATSPTRHPISA HQIMYELRIYSLEEATFGIVLASRPVRAAHCLTSIQFSP TSEHLLLAYGRRHSSLLKSIVIDGENTVPIYTILEVYRV SDMELVRVLPSAEDEVNVACFHPSVGGGLIYGTKEGKLR ILHYDSSHGLNLKSSGFLDENVPEVQTYALEC |
| 76 | The amino acid sequence of SEQ ID 342. The conserved G-protein beta WD-40 repeat domains are underlined and the Trp-Asp (WD) repeats signature is in bold. | MDSAVAIAALSLVVGAAIALLFFGNYFRKRRSEVVAMAE ADLQPHPKNPSRPPPQPAAKKVHAKSHAHGADKDKNKRH HPLDLNTLKGHGDSVTGLCFASDGRSLATACADGVVRVF KLDDASNKSFKFLRINLPAGGHPTAVAFGDGVSSVIVAS QHLSGCSLYMYGEEKPTNLDSNKQQTKLPMPEIKWEHHK VHEQKAILTLSGAAANYDSGDGSTIIASCSEGTDIIIWH AKTGRILGNVDTNQLKNTMSAISPNGRFIAAAAFTADVK VWEIVYSRDGSVKGVTKVMQLKGHKSAVTWLCFTPNSEQ IVTASKDGSIRIWNINVRYHLDEDTKTLKVFPIPLQDSS |

TABLE 11-continued

Annotated Peptide Sequences of the Present Invention.

| Entry | Sequence Description | Annotated Peptide Sequence |
|---|---|---|
| | | GTTLHYERLSLSPDGKILAATHGSMLQWLCIETGKV<u>LDT</u><br><u>AEKAHDGDITCMSWAPQSIPTGDKKVNVLATASGDKKVK</u><br><u>LWAAPPLPS</u> |
| 77 | The amino acid sequence of SEQ ID 343. The conserved G-protein beta WD-40 repeat domains are underlined. | MEVEPKKASKTFPVKPKLKPKPRTPSGKTPESKYWSS<u>FK</u><br><u>TTHPLDNLSFSVPSLAFSPSPPHLLAAAHSATVSLFSPH</u><br><u>RTTISSFSDVVSSLSFRSDGQLLAASDLSGLIQVFDVRS</u><br><u>RTPLRRLRSHARPVRFVRYPVLDKLHLVSGGDDALVKYW</u><br><u>DVAGES</u>VVSELRGHKDYVRCGDCSPADANCFVTGSYDHV<br>VKLWDVRVRDGNRAATEVNHGSPVQDVIFLPSGSLVATA<br>GGNSVKIWDLIGGGRMVYSNESHNKTVTSICVGTNGAQQ<br>SGEEGVQLRILSVGLDGYMKVFDYSRMKVTHSMRFPAPL<br>LSIGFSPDSNVRAIGTSNGILYVGKRKAKENAEGGANGI<br>LGLGSVEEPRRRVLKPSFYRYFHRGQSEKPSEGDYLVMR<br>PKKVKLAEHDKLLKKFQHKNALISVLGGNDPEKVVAVME<br>ELVARRALLKCVLNLDADELGLILTFLHKNSTVPRYSSL<br>LLGLAKKVIDLRLEDIRASDALKGHIRNLKRSVDEEIRI<br>QEGLQEIQGMVSPLLRIAGRR |
| 78 | The amino acid sequence of SEQ ID 344. The conserved G-protein beta WD-40 repeat domains are underlined. | MQGGSSGVGYGLKYQARCISDVKADTDHTSFLTGTLSLK<br>EENEVHLLRLSSGGTELICEGLFSHPSEIWDLSSCPFDQ<br>RIFSTVFSTGESYGAAVWQIPELYGQLNSP<u>QLEKIASLD</u><br><u>AHSRKISCVLWWPSGRHDKLVSIDEENIFLWGLDCSKKS</u><br><u>AQVQSQESAGMLHNLSGGAWDPHDVNTVAATCESSIQFW</u><br><u>DLRTMKKANSLESVHARDLDYDMRKKHLLVTSEDESGVR</u><br>VWDLRMP<u>KAPIQEFPGHTHWTWAVRCNPDYEGLILSAGT</u><br><u>DSAVNLWWSSTASSDELISERLIDSPTRKL</u>DPLLHSYND<br>YEDSVYGLAWSSREPWIFASLSYDGRVVVESVKPFLSRK |
| 79 | The amino acid sequence of SEQ ID 345. The conserved G-protein beta WD-40 repeat domains are underlined. | MAEEEGSAELEQQLEEEFAVWKKNTPILYDLLISHALEW<br>PSLTVHWAPLLPQPSSSAAAAAGDPSLAAHRLVLGTHTS<br>DGAPNFLILADALLPSSESDHCGDDAVLPKVEISQKIRV<br>DGEVNRARFMPQNHNIVGAKTNGCEVYVFDCSKQAAKQH<br>DGGFDPDLRLTGHDGEGYGLSWSPLKENYLLSASHDKKI<br>CLWDISAAAQDKV<u>LGAMHVFEAHEGAVGDASWHSKNDNL</u><br><u>FGSAGDDCQLMIWDLRTN</u>KAQQCVKAHEKEVNSVSFNSY<br>NDWILATASSDTTVGLFDMRKLTTPLHVFSSHEGEVLQV<br>EWDPNHEAVLASSSEDRRVMV<u>WDLNRIGDEQQEGDASDG</u><br><u>PAELLFSHGGHKAKISDFSWNKNEPWVISSSVAEDNSVQV</u><br><u>WQ</u>MAESICGDDDDMQAMEGYI |
| 80 | The amino acid sequence of SEQ ID 346. The conserved G-protein beta WD-40 repeat domains are underlined. | MGNYGEEDEDQYFDALEETASVSDRGSNSSDCCSSGSGL<br>DENVLDSLGFEFWTKFPESVRARRNRFLNLTGLGIEANS<br>VDKEDAFPPSCNEIEVYTCKVTRDDGAVQRSLDSYNCIS<br>LLQSSTSIRSNQEVESLRGDSLLSSFRGRSKESDDLTEL<br>CGMGCPESKRNAVSEFGSVSQGSIEELRRIVASSPLVHP<br>LLHRKLEYERELIETKQKMGAGWLRKFGSATCISGRQGD<br>TWSDPDDLEITAGMKMRRVRAHSSKKKYKELSSLYAAQE<br>FLAHEGSISTMKFSMDGQY<u>LASAGEDTVVRVWK</u>VTEEDR<br>SERVNVTVDPSCLYFALNESTQLASLNTNKEHIGKAKTF<br>QRSSDSSCVILPLKVFQITEKPWHEFKGHNGEVLDLSWS<br>SKGY<u>LLSSSTDKTVRLWRV</u>GCDRCQRVYSHNDYVTCISF<br>NPVNENF<u>FISGSIDGKVRIWN</u>VFGGQVVAYIDCREIVSA<br>VCYRSDGKGAIVGTMTGNCLFYSIKDNHLQMDAQVYLHG<br>KKKSPGKRITGFQFPPNDPGKLNITSADSVIRVLSGLDV<br>VCKLKGPRNSGGPMIATFTSDGKHVISASEDSNVYIWNY<br>AGGDKTSSRVKKIWSCESFWSSNASVALPWCGIRTVPEA<br>LAPPSRSEERRASCAENGENHHMLEEYFQKMPPYSPDCF<br>SLSRGFFLELLPKGSATWPEEKLSDTSPPTVSSQAISKL<br>EYKFLKSACHSVLSSAHMWGLVIVTAGWDGRIRTYHNYG<br>LPVRS |
| 81 | The amino acid sequence of SEQ ID 347. The conserved G-protein beta WD-40 repeat domains are underlined. | MDIDFKEYR<u>LRCELRGHEDDVRGVCVCGDGSIGTSSRDR</u><br><u>TVRLWAPSAGERRKYEVARVLLGHKSFVGPLAWVPPSEE</u><br><u>LPEGGIVSGGMDTLVMAWDLRMGEAQTLKGHQLQVTGIV</u><br><u>LDGGDIVSASVDCTLIRWKNGQLTEHWEAHKAPIQAVIR</u><br><u>LPSGELVTGSSDTTLKLWRGKTCTQTFVGHTDTVRGLAV</u><br><u>MPDLGILSASHDGSIRLWAVSGECLMEMVDHTSIVYSVD</u><br><u>SHASGLIVSGSEDRFAKIWKDGVCFQSIEHPGCVWDVKF</u><br><u>LEDGDIVTACSDGTIRIWTN</u>QEDRMANSTELELFDLELS<br>SYKRSRKRVGGLKLEELPGLEALQVPGTSDGQTKVIREG<br>DNGVAYAWNSTELKWDKIGEVVDGPEDSMNRPALDGVQY<br>DYVFDVDIGDGEPTRKLPYNRSDNPYDTADKWLLKENLP<br>LSYRQQIVEFILANSGQRDFNLDPSFRDPYTGSSAYVPG<br>APSQLAAKQARPTFKHIPKKGMLVFDAAQFDGILKKINE |

TABLE 11-continued

Annotated Peptide Sequences of the Present Invention.

| Entry | Sequence Description | Annotated Peptide Sequence |
|---|---|---|
|  |  | FNNTLLSNQEKKNLSLTDIEISRLGAVVKILRDTSHYHS SKFADADFDLMLKLLESWPYEMMFPVIDIFRMVILHPDG ADGLLRHQEDKKDVLMESIKRATGNPSVPANFLTSIRAV TNLFKNSAYYSWLQKHRSEMLDAFSSCSSSSNKNLQLSY ATLLLNYAVLLIEKKDEEGQSQVLSAALELAENESLEVD ARYRALVAIGSLMLDGLVKRIALDFDVEHIAKAARTSKE AKIAEVGADIELLIKQS |
| 82 | The amino acid sequence of SEQ ID 348. The conserved G-protein beta domain is underlined and the WD-40 repeat domains are in bold | MEFTEAYKQSGPCCESPNARFIAVAVDYRLVIRDTLSLK VVQLFSCLDKISYIEWALDSEYILCGLYKRPMIQAWSLI QPEWTCKIDEGPAGIAYARWSPDSRHILTTSDFQLRLTV WSLVNTACVHVQWPKHASKGVSFTRDGKFAAICTRHDCK DYINLLSCHNWEIMGVFAVDTLDLADIQWSPDDSAIVIW DSPLEYKVLVYSPDGRCLFKYQAYESGLGVKSVSWSPCG QFLAVGSYDQMLRVLSHLTWKTFAEFTHLSNVRAPCCAA IFREVDEPLQIDMSELSLSDDYMQGNSGDAPEGHYRVRY DVTEVPITLPCQKPPADRPNPKQGIGLMSWSNDSQYICT RNDSNPTILWIWDMRHLELAAILVQKDPIRAAVWDPTGT RLVLCTGSSHLYHWTPSGAYCVSVPLSQFNITDLKWNSD GSCLLLKDKESFCCAAAPLPPDESSDYSSDD |
| 83 | The amino acid sequence of SEQ ID 349. The conserved G-protein beta WD-40 repeat domains are underlined. | MATIAALDDDMVRSMSI<u>GAVFSDFVGKLNSLDFHRKDDI LVTAGEDDSVRLYD</u>IANARLLKTTFHKKHGTDRVCFTHH PNSLICSSTKNLDTGESLRYISMYDNR<u>SLRYFKGHKQRV VSLCMSPINDSFMSGSLDHSVRMWDLRVNACQGILRLRG</u> RPTVAYDQQGLVFAVANEGGAIKLFDSRSYDKGPFDAFL <u>VGGDTSEVCDIKFSNDGKSVLLSTTNNNIYVLDAYAGDK QCGFNLEPSPSTPIEASFSPDGQYVVSGSGDGTLHAWNI SRRNEVACWNSHIGVASCLKWAPRRANFVAASTVLTFWI</u> PNSEPELASAKGEAGVPPEQV |
| 84 | The amino acid sequence of SEQ ID 350. The conserved G-protein beta WD-40 repeat domains are underlined and the beta G-protein (transducin) is in bold. | MSVAELKERHRAATETVNSLRERLKQKRVQLLDTDVAGY ARTQGKTPVTFGATDLV<u>CCRTLQGHTGKVYSLDWTPERN RIVSVSQDGRFIVWNALTSQKTHAIRLPCAWVMTCAFAP NGQSVACGGLDSVCSIF</u>NLNSPVDRDGNLP<u>VSRMLSGHK GYVSSCQYVPDGDAHLITGSGDQTCVLWDITTGLRTSVF GGEFQSGHTADVLSVSINGSSPRIFVSGSCDSTARMWDT</u> RVAS<u>RAVHTYHGHEGDVNAVKFFPDGNRFGTGSDDGTCR LFDIRTGHELQVYYQQRGIDEIPHVTSIAFSISGRLLIA GYSNGDCFVWDTLLAQVVLNLGSLQNSHEGRISCLGVSA DGSALCTGSWDTNLKIWAFGGIRRVT</u> |
| 85 | The amino acid sequence of SEQ ID 351. The conserved G-protein beta domain is underlined and the WD-40 repeat domains are in bold | MKKRPRGASLDQAVVDIRRREVGGLSGLSFARRLAASEG LVLRLDIYNKLKGHRGCVNTVGFNLDGDIVISGSDDEHV KLWDWQTGKVKLSFDSGHLSNVFQAKIMPYTDDRSIVTC AADGQARHAQILEGGQVQTMLLAKHRGRAHKLAIDPGSP HIVYTCGEDGLVQRLDLRSNTARELFTCEEVYGTHVEVV HLNAIAIDPRNPNLFVIGGSDEYARVYDIRNYKWNGSHN FGRSANYFCPSHLIGEAHVGITGLAFSCQSELLVSYNDE SIYLFTQEMGLGPDPLSASTKSVDSNSSEVTSPTAVNVD DNVTPQVYKGHRNCETVKCVGFFGPKCEYVVSGSDCGRI FIWKKKGGQLIRVMAADKIWVNCIEPHPHIPALASSGIE NDIKIWTPKAIERATLPMNVEQLKPKARGWMNRISSPRQ LLLQLYSLERWPEEGGETSSGLAAGQEELTELFFALSAN GNGSPDGGGDPSGPLL |
| 86 | The amino acid sequence of SEQ ID 352. The conserved G-protein beta WD-40 repeat domains are underlined and the Trp-Asp (WD) repeats signature is inbold. | MSKR<u>GYKLQEFVAHSSNVNCLSIGKKACRLFLTGGDDCK VNLWAIGKPNSLNSLCGETNAVESVAFDSAEVLVLAGAS SGVIRLWDVEEAKLVRGLTGHRSNCTAMEFHPFGEFFAS GSTDTNLKIWDIRKKGCIHTYKGHTRGISTIRFSPDGRW VVSGGNDNVVKVWDLTAGKLLHDFKFHENHIRSIDFHPL EFLLATGSADRTVKFWDLE</u>TFELIGSSRPEAAGVRAIAF HPDGRTLFCGLEDSLKVYSWEPVICHDGVDNGWSTLADL CIHDGKLLGCSYYQSSVGVWVADASLIEPYGTNVKPQQK DSGDDEIEHQESRPSAKVGTTIRSTSIMRCASPDYETKD IKNIYVDTASGNPVSSQRVGTTNFAKVTQPLDFNDTPNL TLRRQGLVTETPDGLSGHVPSKSITQPKVVSRDSPDGKD SSRRESITFSRTKPGMLLRPAHSRRPSSTKYDVDRLSAC AEIGVLSSAKSGSESLVDSFLNIKVAPEDGARNGCEDNH SSVKNVSVESEKVLPLQTPKTEKCDQTVGFKEEINSVKF VNGVAVVPGRTRTLVEKFEKREKLNSTEDQTINTPENPT LDKTPPPSLAENEEKSDRLNIVERKATRMSSHMVTAEDR TPVTLVGSPEDQSTVMAPQRELFADESSKTPPLPVEDLE IHHGSNVSEDKATILSSQTVSEEDSKRSTLIRNFRRRDR FKSTEGRSPVMATQRKLPTDESGKTSSLPMEDLEIKGGL |

TABLE 11-continued

Annotated Peptide Sequences of the Present Invention.

| Entry | Sequence Description | Annotated Peptide Sequence |
|---|---|---|
| | | NVSEDKATSFSSRAPPREDRAHSALVRNVRKRDKFKSTN DTITVMVHQRGLSTDEASTVSVERVERRQLSNNVENPLN NLPPHSVPPTTTRGEPQYVGSESDSVNHEDVTELLLGNH EVFLSTLRSRLTKLQVV |
| 87 | The amino acid sequence of SEQ ID 353. The conserved G-protein beta WD-40 repeat domains are underlined. | MSTFLTGTALSNPNPNKSYEVVQPPNDSVSSLSFNPKAN FLVATSWDNQVRCWEIVRSGTSLGTTPKASISHDQPVLC STWKDDGTTVFSGGCDKQVKNWPLSGGQPMTVAMHDAPI KEISWIPEMNLLVTGSWDRTLRYWDTRQANPVHIQQLPE RCYALTVRHPLMVVGTADRNLIIYNLQSPQTEFKRISSP LKYQTRCLAAFPDQQGFLVGSIEGRVGVHHLDDSQQSKN FTFKCHREGSEIYSVNSLNFHPVHHTFATAGSDGAFNFW DKDSRQRLKAMSRCSQPIPCSTFNNDGSIFAYSACYDWS KGAENHNPATAKTYIFLHLPQESEVKGKPRLGTTGRK |
| 88 | The amino acid sequence of SEQ ID 354. The conserved G-protein beta WD-40 repeat domains are underlined and the Trp-Asp (WD) repeats signatures are in bold. | MEVEAQQRDVNNVNCQLVDPEGTTLGPPMYLPQDVGPQQ LQQMVNKLLSNEDKLPYTFYISDQELVVPLESYLQKNKV SVEKVLSIVYQPQAIFRIRPVNRCSATIAGHSEAVLSVA FSPDGKQLASGSGDTTVRLWDLSTQTPMFTCRGHKNWVL SIAWSPDGKHLVSGSKAGEIQCWDPLTGQPSGNPLVGHK KWITGISWEPVHLSSPCRRFVSSSKDGDARIWDVTLRRC VICLSGHTLAVTCVKWGGDGVIYTGSQDCTIKVWETSQG KLIRELKGHGHWVNSLALSTEYVLRTGAFDHTGKQYSSA EEMKQVALERYKMKKGNAPERLVSGSDDFTMFLWEPSVS KHPKTRMTGHQQLVNHVYFSPDGQWVASASFDKSVKLWN GITGKFVAAFRGHVGPVYQISWSADSRLLLSGSKDSTLK IWDIRTKKLKRDLPGHADEVFAVDWSPDGEKVVSGGKDK VLKLWMG |
| 89 | The amino acid sequence of SEQ ID 355. The conserved G-protein beta WD-40 repeat domains are underlined. | MDAGSAHSSSNNKTQSRSPLQEQFLQRRNSRENLDRFIP NRSAMDFDYAHYMLTEGRKGKENPAVSSPSREAYRKQLA ETLNMNRTRILAFKNKPPTPVELIPHELTSAQPAKPTKT RRYIPQTSERTLDAPDLLDDYYLNLLDWGSSNVLSIALG NTVYLWNASDGSTSELVTIDDETGPVTSVSWAPDGRHIA VGLNNSDVQLWDSADNRLLRTLRGGHRSRVGSLAWNNHI LTTGGMDGLIVNNDVRVRSHIVDTYRGHTQEVCGLKWSA SGQQLASGGNDNILHIWDRSTASSNSPTQWLHRLEEHTA AVKALAWCPFQGNLLASGGGGGDRTIKFWNTHTGACLNS VDTGSQVCALLWNKNERELLSSHGFTQNQLTLWKYPSHV KIAELTGHTSRVLFMAQSPDGCTVASAAGDETLRFWNVF GVPEVAKPAPKANPEPFAHLNRIR |
| 90 | The amino acid sequence of SEQ ID 356. The conserved G-protein beta WD-40 repeat domains are underlined and the Trp-Asp (WD) repeats signature is in bold. | MEEAIPFKNLPSREYQGHKKKVHSVAWNCTGTKLASGSV DQTARVWHIEPHGHGKVKDIELKGHTDSVDQLCWDPKHA DLIATASGDKTVELWDARSGKCSQQAELSGENINITYKP DGTHVAVGNRDDELTILDVRKFKPIHKRKFNYEVNEIAW NMSGEMFFLTTGNGTVEVLAYPSLRPVDTLMAHTAGCYC IAIDPVGRYFAVGSADSLVSLWDISEMLCVRTFTKLEWP VRTISFNHTGDYVASASEDLFIDISNVQTGRTVHQIPCR AAMNSVEWNPKYNLLAYAGDDKNKYQADEGVFRIFGFES A |
| 91 | The amino acid sequence of SEQ ID 357. The conserved G-protein beta WD-40 repeat domains are underlined | MGKDEEEMRGEIEERLINEEYKVWKKNTPFLYDLVITHA LEWPSLTVEWLPDREEPPGKDYSVQKLVLGTHTSENEPN YLMLAQVQLPLEDAENDARHYDDDRADVGGWGCANGKVQ IIQQINHDGEVNRARYMPQNSFIIATKTVSAEVYVFDYS KHPSEPPLDGACSPDLRLRGHSTEGYGLSWSKFKQGHLL SGSDDAQICLWDINATPKNKSLDAMQIFKVHEGVVEDVA WHLRHEYLFGSVGDDQYLLIWDLRTPSVTKPVQSVVAHQ SEVNCLAFNPFNEWVVATGSTDKTVKLFDLRKISTALHT FDAHKEEVFQVGWNPENETILASCCLGRRLMVWDLSRID EEQTPEDAEDGPPELLFIHGGHTSKISDFSWNTCEDWVV ASVAEDNILQIWQMAENIYHDEDDVPGEESNKGS |
| 92 | The amino acid sequence of SEQ ID 358. The conserved G-protein beta WD-40 repeat domains are underlined. | MMRGFSCTEDGDAPSTSSTSPPPPPPPPHRQQMQAPRAS SSSSGQPTSRRSTGNVFKLLARREVSPRSKHSLKKFWGE ASECQLCPFQQSYEAVRDVRRSLISWVEAFSLQHLSAKY CPLMPPPRSTIAAAFSPDGKILASTHGDHTVKLIDSQTG SCLKVLRGHRRTPWVVRFHPLYPEILASGSLDHEVHLWD ANTAECIGSRNFYRPIASIAFHAQGDLLAVASGHKLYIW HYNRSGETSSPTIVLRTPRSLRAVHFHPHAAPFLLTAEV NDLDLTDSAMTLATSPGYLHYPPPTIYLADAHSNERSRL EDELPLMPSPLLMWPSFTRDDGRATLPHIGGDVGLSGQQ RVDSLSSGQYEFHPSPIEPSSSTSMHEEMGTDPFSSVRE SEVTQSAMNIVDNTEVQPEERSTYSFSFSDPRFWELPSV |

TABLE 11-continued

Annotated Peptide Sequences of the Present Invention.

| Entry | Sequence Description | Annotated Peptide Sequence |
|---|---|---|
| | | YGWLVGQTQAAPRTAPSPGALETASALGEVASVSPVRSE FMPGGMDQPRLGGRSGSGCRSSGSRMMRTAGLNDHPHDE NYPQSVVSKLRSELEASLAAAASTELPCTVKLRVWPYDM KDPCALFRSESCRLTIPHAVLCSEMGAHFSPCGRFFAAC VACVLPQLEADPVLHGQVDPDVTGVATSPTRHPVSAYQI MYELRIYSLEEATFGMVLASRSIRAAHCLTSIQFSPTSE HLLLAYGRRHNSLLKSIVIDGENTVPIYSILEVYRVSD<u>M ELVRVLPSAEDEVNVACFHPSVGGGLVYGTKEGKLRILQ</u> IDSSGGLNPKSTGFLDENMAEVPTYALEC |
| 93 | The amino acid sequence of SEQ ID 359. The conserved G-protein beta WD-40 repeat domains are underlined. | MGEGDLPR<u>TEAGVLRGHEGAVLAARFNGDGNYCLSCGKD RTIRLWNPHRGIHIKTYKSHGREVRDVECTSDNSKLISC GGDRQIFYWDVSTGR</u>V<u>IRRFRGHDSEVNAVKFNDYASVV VSAGYDRSVRAWDCRSHSTEPIQIINTFQDSVMSVCLTK TEIIGGSVDGTVRTFDIRIGREISDDLGQPVNCISMSND GNCILASCLDSTLRLVDRSAGELLQEYKGHTCKSYKLDC CLTNTDAHVAGGSEDGYVFFWDLVDASVISKFRAHSSVV TSVSYHPKEDCMITASVDGTIKVWKT</u> |
| 94 | The amino acid sequence of SEQ ID 360. The conserved G-protein beta WD-40 repeat domains are underlined | MACIKGVGRSASVAMAPDGGYLATGTMAGTVDLSFSSSA SLEIFGLDFQSDDRDLPLIAESPSSERFNRLSWGKNGSG SDEFSLGLIAGGLVDGTIGLWNPLSLIRSEAGD<u>KAIVGH LSRHKGPVRGLEFNVIAPNLLASGADDGEICIWDLAAPR EPSHF</u>P<u>PLRGSGSAAQGEISFLSWNSKVQHILASTSYNG TTVVWDLKKQKPVISFSDSVRRRCSVLQWNPDLATQLVV ASDEDSSPTLRLWDMRNI</u>M<u>SPVKEFAGHTRGVIAMSWCP NDSSYLVTCAKDNRTIC</u>WDTVT<u>GEIVCELPAGSNWNFDV HWYPKIPGVISASSFDGKIGIYN</u>VEGCSRYGVRENEFGA ATLRAPKWFKRPVGASFGFGGKVVSFHTRSTGGPSVNSS EVFVHDIITEQTLVSRSSEFEAAIQSGDRPSLRALCERK SQHCESTDDQETWGFLKVLLEDDGTARSKLLAHLGFDIP TETNDGSQEDLSQQVNALGLEDVTADKVVQEDNNESMVF PTDNGEDFFNNLPSPRADTPVSTSADGFPTVNAAVEPSQ DEVDGLEESSDPSFDDSVQRALVVGDYKAAVALCMSANK LADALVIAHVGGASLWESTRDKYLKNSRLPYLKVVFAMV NNDLQSLVDTRPLKFWKETLAILCSFAQGEEWAMLCNSL ASKLMAAGNMLAATLCFICAGNIDKTVEIWSRSLATEHD GMSYMDLLQDLMEKTIVLALASGQKQFSASVCKLVEKYA EILASQGLLTTAMDYLKLLGTDDLSPELAVLRDRIAFSV EAEKGANISAFNGSQDPRGAVYGVDQSNYGMVDTSQHYY PEAAQPQVPHTVPGSPYGENYQQPFGSSFGKGYNTPMQY QAPSQASMFVPSEPPQNAQPSFVPTPVTSQPTTRSQFIP APPLALRNPEQYQQPTLGSHLYPGSVNPTFQPLPHAPGP VAPVPPQVSSVPGQNMPQAVAPTQNRGFMPVTNPGVVQN PGPISMQPATPIESAAAQPVVSPAAPPPTVQTADTSNVP APQKPVIATL |
| 95 | The amino acid sequence of SEQ ID 361. The conserved G-protein beta WD-40 repeat domains are underlined. | MKERGKGAGRSVDERYTQWKSLVPVLYDWLANHNLVWPS LSCRWGPQLEQATYKNRQRLYLSEQTDGSVPNTLVIANV EVVKPRVAAAEHISQFNEEARSPFVKKFKTIIHPGEVNR IRELPQNSKIVATHTDSPDVLIWDVETQPNRHAVLGAST SRP<u>DLILTGHKDNAEFALAMSPTEPFVLSGGKDRYVVLW SIQDHISTLAADPGSAKSPGSAGTNNKQSSKAAGGNDKT GDSPSIEPRGVYLGHGDTVEDVTFCPSSAQEFCSVGDDS CLILWDARTGSSPAIKVEKAHHADLHCVDWNPHDVNLIL TGSADNTVRMFDRRNLTSGGVGSPVHTFEGHNAAVLCVQ WSPDKSSVFGSSAEDGILNIWDHEKIGRKIETVGSKVPN SPPGLFFRHAGHRDKVVDFHWNSSDPWTIVSVSDDGEST GGGGTLQIWR</u>MIDLIYRPEEEVLAELDKFKSHILSCTS |
| 96 | The amino acid sequence of SEQ ID 362. The conserved G-protein beta WD-40 repeat domains are underlined and the Trp-Asp (WD) repeats signature is in bold. | MAKIAPGCEPVAGTLTPSEKREYRVTNRLQEGKRPLYAV VFNFIDSRYFNVFATVGGNRVTVYQCLEGGVIAVLQ<u>SYI DEDKDESFYTVSWACNIDRTPFVVAGGINGIIRVIDAGN EKIHRSFVGHGDSINEIRTQPLNPSL</u>IVSASKDESVRLW N<u>VHTGICIL</u>I<u>FAGAGGHRNEVLSVDFHPSDKYRIASCGM DNTVKIWSMKEFWTYVEKSFTWTDLPSKFPTKYVQF</u>P<u>VF IAPVHSNYVDCMRWLGDFVLSKSVDNEIVLWEPKMKEQS PGEGSVDILQKYPVPECDIWFIKFSCDFHYHSIAIGNRE GKIYVWELQSS</u>P<u>PVLIAKLSHPQSKSPIRQTAMSFDGST ILSCCEDGTIWRW</u>DAITASTS |
| 97 | The amino acid sequence of SEQ ID 363. The conserved G-protein beta WD-40 repeat domains are underlined. | MNTAMHFGAGWRSIAEMGYTMSRLEIEPESCEDEKSLDG VGNSQGPNELPRCLDHELAHLTNLKSRPHEHLIRDFPGR RALPVSTVKMLAGRECNYSRRGRFSSADCCHMLSRYVPV NGPSPLDQMNSRAYVSQFSADGSLFVAGFQGSHIRIYNV |

TABLE 11-continued

Annotated Peptide Sequences of the Present Invention.

| Entry | Sequence Description | Annotated Peptide Sequence |
|---|---|---|
| | | DKGWKCQKNILTKSLRWTITDTSLSPDQRYLVYASMSPI VHIVDIGSAAMDSLANITEIHEGLDF<u>SADSGPYSFGIFS VKFSTDGREVVAGSSDDSIYVYDLVANKLSLRIPAHESD VNTVCFADESGHIIYSGSDDTYCKVWDRRCLSARNKPAG VLMGHLEGITFIDSRGDGRYFISNGKDQTIKLWDIRKMG</u> SDICRRGFRNFEWDYRWMDYPPRARDSKHPFDL<u>SVATYK GHSVLRTLIRCYFSPVHSTGQKYIYTGSHDSCVYIYDVV TGAQVAALKHHKSPVRDCSWHPEYPMIVSSSWDGDIVKW EFFGNGETEIPAMKKRIRRRHLY</u> |
| 98 | The amino acid sequence of SEQ ID 364. The conserved G-protein beta WD-40 repeat domains are underlined. | MEPQPQAPKKRGRKPKPKEDEKEEQLHQPPPPPPPQQQA APAPAPAATRSSTSGSAGGRDRRPQQQHAVDEKYARWKS LVPVLYDWLANHNLLWPSLSCRWGPQLEQATYKNRQRLY ISEQTDGSVPNTLVIANCEVVKPRVAAAEHVSQFNEEAR SPFIRKYKTIIHPGEVNRVRELPQNPNIVATHTDSPDVL IWDVESQPNRHAVYGATASRPNLILTGHQENAEFALANC PAEPFVLSGGKDKTVVLWSIQDHITASATDQTTNKSPGS GGSIIRKTGEGNEETGNGPSV<u>GPRGIYCGHEDTVEDVAF CPSTAQEFCSVGDDSCLILWDARVGTNPVAKVEKAHNGD LHCVDWNPHDNNLILTGSADNSVNMFDRRNLTSNGVGSP VYKFEGHKAAVLCVQWSPDKPSVFGSSAEDGLLNIWDYE RVDKKVDRAPNAPAGLFFQHAGHRDKIVDFHWNAADPWT MVSVSDDCDTAGGGGTLQIWRNSDLIYRPEEEVLAELEN FKAHVLECSKA</u> |
| 99 | The amino acid sequence of SEQ ID 365. The conserved G-protein beta WD-40 repeat domains are underlined and the Trp-Asp (WD) repeats signature is in bold. The Utp21 specific WD40 associated putative domain is in italics. | MGIFEPYRAVGYITTGVPFSVQRLGTETFVTVSVGKAFQ VYNCAKLSLVLVGPQLPKKIRALASYREYTFAAYGSDIG IFKRAHQLATWSGHTAKVCLLLLEGEHILSVDVDGNAYI WAFKGMNYNLSPVGHILLDSNFTPSCIMHPDTYLWKVIL GSQEGPLQLWNISTKTKLYEFKGWNSSVSSCVSSPALDV VAVGCADGKIHVHMIRYD<u>EELVTFSHSMRGSVTALSFST DGQPLLASGSSSGVVSIWNLDKRRLQSVIRDAHDGSIIS</u> LHFFANEPVLMSSSADNSIKMWIFDTSDGDPRLLRFRSG HSAPPLCIRFYANGRHILSAGQDRAFRLFSVVQDQQSRE LSQRHVSKRAKKLKLKEEEIKLKPVIAFDVAEIRERDWC NVVTSHMDTPQAYVWRLQNFVIGEHILRPCPNKPTPVKA CMISACGNFAILGTAGGWIERFNLQSGISRGSYIDQLEG TNSAHDGEVVGVACDATNTLMISAGYAGDIKVWDFKGRE LKSRWEIGSSLVKISYHRLNGLLATVADDFIIRLFDAVA <u>LRMVRKFEGHTDRITDLCFSEDGKWLLSSSMDGSLRIWD</u> IILARQVDAVFVDVSITALSLSPNMDILATTHVDQNGVF LWVNQSMFSGDSDINLYASGKEVVTVKLPSVSSVEGS*QV EESNEPTIRHSESKDVPSFRPSLEQIPDLVTLSLLPKSQ WQSLINLDIIKVRNKPVEPPKKPEKAPFFLPSIPSLSGE ILFKPSEMSDKGDMKADEDKSKITPEVPSSRFLQLLHSC SEAKNFSPFTTYIKGLSPSTLDLELRMLQIIDDDAVDAD ADDPQDVDKRQELLSIELLMDYFIHEISCRSNFEEVQAL VRLFLKIHGETIRRQSVLQNKAKVLLETQCSVWQRVDKL FQGARCMVAFLSNSQF* |
| 100 | The amino acid sequence of SEQ ID 366. The conserved G-protein beta WD-40 repeat domains are underlined. | MEETKVTCGSWIRRPENVNLAVLGRSPRRRGSAALEIFA FDPKSTSLSSSPLVAHVIEEIEGDPLAIAVHPNGEDIVC FASSGSCLSFELSGQESNLKLLTK<u>ELPPLRGIGPQKCMA FSVDGSRFATGGVDGRLRILEWPSLRII</u>L<u>DEPKAHKSIR DLDFSLDSEFLATTSTDGSARIW</u>KAEDGLPCTTLTRRSD EKIELCRFSKDGTKPFLFCTVQRGDKAVTGVWDISTWNK IG<u>HKRLLRKPAVVMSISLDGKYLAQGSKDGDMCVVEVKK</u> MEVSHWSKRLHLGTSLTSLEFCPIERVVITTSDEWGVLV TKLNVPADWKAWQVYLLLLGLFLASLVAFYIFYENSDSF WGFPLGKDQPARPKIGSVLGDPKSADDQNMWGEFGPLDM |
| 101 | The amino acid sequence of SEQ ID 367. The conserved G-protein beta WD-40 repeat domains are underlined. | MADPVEHQHQQHQQHQLQQQRRRGWRIQGGQYLGEISAL CFLHLPPPPLSLSSSPVLSLSSGLDSESRDRPACSFRFP SAGSGSQVSLFDLASGAMVRTFYVFRGIRVHGIVLGCAD FPGGSSSSSSTLDYVIAVYGERRVKLFRLSVRLGRGAGE GSGTVLSADLELVSAAPRLSHWVMDVRFLKENGTSEDEL QRCLTVAIGCSDNSIRLWDVDKCSFVLAVSSPERCLLYS MRLWGDNLEDLQVASGTIYNEILIWKVVPNHDAPSSNEL TEEGLTNSCAGNSVHECLRYE<u>AYHICRLVGHEGSIFRIA WSSDGSKLVSVSDDRSARIW</u>EVHCKVQYSEDA<u>GEVGLLF GHSARVWDCYISQNLIVTAGEDCSCRVWGLDGQQ</u>HDVIK EHIGRGIWRCLYDPWSSLLVTGGFDSAIRVHKLDASLAE ASAKQSNIKDLSDGTELFTTHLPNSSGHSGHMDSKSEYV RCLSFSCEDVMYIATNHGYLYHAKLCNDGDLRWTELAQV SNEVQIICMELLPSNPYDPRIDADDDWVAVGDGKGWTTVV |

TABLE 11-continued

Annotated Peptide Sequences of the Present Invention.

| Entry | Sequence Description | Annotated Peptide Sequence |
|---|---|---|
|  |  | RVVKNSDSPKVSTSFSWAAEMDRQLLGIHWCKSLGHRFI FTADPRGALKLWRFFEVSQSSSLYPENSPRISLIAEFKS DLGARIMCLDVAFESELLICGDLRGNLVLFPLLKDLLLD TFVVSAAKISPVNHFKGAHGISAVSSISVAHMSFNHIEL RSTGADGCICYNEYDKGLQSLNFVGNKQVKELSMIESVS TENESTGYRTSGSYASGFASTDFIIWNLVTEAKVLQVSC GGWRRPHSYYLGDVPEMKNCFAYVKDDIIYIRREWIKDS KQKILPQNLRLQFHGREVHSLCFVTGDFQLRKNKQSSWI VTGCEDGTVRLTRYTQCTDNWSSSKLLGEHVGGSAVRSI CCVSNIHTTSSGTSVSDVKGIENLPKDIKGTLMEDECNP SLLISVGAKRVLTSWLLRRRKQDGKEDDVTDLQEAENSS LPSSAGSSTFSFQWLSTDMPVKYSVPSKKSGSIKKLIGV SDTNVRCKSL |
| 102 | The amino acid sequence of SEQ ID 368. The conserved G-protein beta WD-40 repeat domains are underlined. | MPYK<u>LSATLSNHSSDVRAVASPSDDLILSASRDSTAISW FRQSPSSFTPASVIRAGSRFVNAIAYLPPTPRAPQGYAV VGGQDTVVNVFALGPGDKEEPEYTLVGHTDNVCALSVNS DDTIISGSWDKTAKVWKDFALVYDLKGHQQSVWAVLAMN EKEFLTASADRTIKYWVQHKTMQTYEGHRDAVRGLALIP DIGFASCSNDSEIRVWTMGGDVVYTLSGHTSFVYSLSVL PNGDLVSAGEDRSVRVWRDGECSQVIVHPAISVWAVSTM PNGDIISGSSDGVVRVFSESEKRWATASELKALEDQIAS</u> QSLPSQQVGDVKKTDLPGPEALSVPGKKAGEVKMIRSGD VVEAHQWDSLASSWQKIGEVVDAIGSGRKQLHDGKEYDY VFDVDIQEGAPPLKLPYNVSENPYTAAQRFLEQNDLPTG YLDQVVKFIEQNTAGVKLGNDGYVDPFTGASRYQPATQS TSNTASSSYNDPFTGGSRHIAESAPSNVPQGSHATGIIP FSKPIFFKLANVSAMQAKMFQFDEVLRNEISTATLAMRP DEVINVNETFTYLSKVVTSTSSARTSLGWIHIETIMQIL DRWPVPQRFPVIDLGRLVTAYCMNAFSGPGDLEKFFSCL FRTSEWTSITSGSKALTKAQETNVLLLFRTIANSLDGAP LNDNEWIKQIFRELAQTPQLVLNKSHRLALASVLFNFSC IGLKGPVPADVRTLHLTIILQVLRSPNDDPEVAYRTCVA LGNMLYSDKTRGTPRDAQSPSPTELKSAVAAIKGGFSDP RINDVHREIMSLI |
| 103 | The amino acid sequence of SEQ ID 369. The conserved G-protein beta domain is underlined and the WD-40 repeat domains are in bold | <u>MPPQKIESGHKDTVHDLAMDYYGKRLATASSDHTINVVG VSSSGSQHLATLIGHQGPVWQISWAHPKFGSLLASCSYD GRVIIWREGNPNEWTQAQVFEEHKSSVNSVAWAPHELGL</u> CLACGSSDGNISVFTARQDGGWDTSRIDQAHPVCVTSVS WAPSTAPGALVGSRGMMEPVQKCSGGCDNTVKVWKLYNR VWKLDCFPVLQMHTDWVRDVAWAPNLGLPKSTIASASQD GRVIIWTLAKEGDQWQCKVLYDFRTPVWRVSWSLTGNIL AVADGNNNVSLWNEAVDGEWIQVSTVEP |
| 104 | The amino acid sequence of SEQ ID 370. The conserved G-protein beta WD-40 repeat domains are underlined and the Trp-Asp (WD) repeats signature is in bold. | MSAPMLEIEARDVVKIVLQFCKENSLHQTFQTLQSECQV SLNTVDSIETFVADINSGRWDAILPQVAQLKLPRNTLED LYEQIVLEMIELRELDTARAILRQTQAMGVMKQEQPERY LRLEHLLVRTYFDPNEAYQDSTKEKRRAQIAQALAAEVT VVPPSRLMALVGQALKWQQHQGLLPPGTQFDLFRGTAAN KQDVDDMY<u>PTTLSHTIKFGTKSHAECARFSPDGQFLVSC SVDGFIEVWDYNSGKLKDLQYQADETFMMHDDPVLCVD FSRDSEMLASGSQDGKIKVWRIRTGQCLRRLERAHSQGV TSVLFSRDGSQLLSTSFDGSARIHGLKSGRQLREFRGHS SYVNDAIFSNDGSRVITASSDCTVKVWDVKTSDCLQTFK PPPPLRGGDASVNSVHLFPKNADHIVVCNKTSSIYIMTL QGQVVKSLSSGKREGGDFVAACVSPKGEWIYCVGEDRNL YCFSCQSGKLEHLMKVHERDVIGVTHHPHRNLVATYSED STMRLWKP</u> |
| 105 | The amino acid sequence of SEQ ID 371. The conserved G-protein beta WD-40 repeat domains are underlined. | MDLLQSYAEQNDGDLGRHSSPEPSPPRLLPSKSAAPKVD DTTLALTVAQTNQTLARPIDPSQHAVAFNPTYDQLWAPI CGPAHPYAKDGIAQGMRNHKLGFVEDAAIGSFLFDEQYN TFQRYGYAADPCASTGNEYVGDLDALKQNDGISVYNIRQ QEQKRYAEEYAKKKGEERGEGGREKAEVVSDKSTFHGKE ERDYQGRSWIAPPKDAKATNDHCYIPK<u>RLVHTWSGNTKG VSAIRFFPKHGHLILSAGMDTKVKIWDVFNSGKCNRTYM GHSRAVRDISFCNDGTKFLTAGYDKNIKYWDTETGKVIS TFSTGRIPYVVKLHPDDEKQNILLAGMSDKKIVQWDMNT GQITQEYDQHLGAVNTITFVDDNRRFVTSSDDKSLRVWE FGIPV</u>VIKYISEPHMHSMPSISLHPNTNWLAAQSLDNQI LIYSTRERFQLNKKKRFAGHIVAGYACQVNFSPDGRFVM SGDEGERCWFWDWKSCRVFRTLKCHEGVCIGCEWHPLEQ SKVATCGWDGLIKYWD |

TABLE 11-continued

Annotated Peptide Sequences of the Present Invention.

| Entry | Sequence Description | Annotated Peptide Sequence |
|---|---|---|
| 106 | The amino acid sequence of SEQ ID 372. The conserved G-protein beta WD-40 repeat domains are underlined. | MESNGNLEQTLQDGRIYRQLNSLIVAHLRDHNFPQAASA VALATMTPLNVEAPRNRLLELVAKGLAVEKGELLRGVSH AGTNDLGGSIPASYGLVPAPWTAIDFSSLRDTKGNSKSF <u>TKHETRHLSDHKNVARCARFSTDGRFFATGSADTSIKLF EVSKIKQMMLPDSTDGA</u><u>IRAVIRTFYDHTHPVNDLDFHP QNTVLISAAKDHTVKFFDYSKATAKRAFRVIQDTNNVRS VAFHPSGDFLLAGTDNPIPHLYDVNT</u><u>FQCYLSANVPEFA VNAAINQVRYSSSGGMYVTASKDGTIRFWDGASANCVRS IAGAHGAAEVTSANFTKDQRYVLSCGKDSTVKLWEVGTG</u> RLVKQYLGATHNQLRCQAVFNNTEEFVLSIDEPSNEIVV WDAM<u>TAEKVARWPSNHNGPPRWIEHSPTEAAFVSCGTDR SIRFWKETH</u> |
| 107 | The amino acid sequence of SEQ ID 373. The conserved G-protein beta WD-40 repeat domains are underlined. | MSNFQGEDGEYVADDFEAEDGDEELHGRESADPESDVDE IDTPSNRFTDTTADQARRGRDIQGIPWERLSITREKYRR TRLEQYRNYENVPQSGERSGRDCTVTERGNSFYEFRRNS RSVKSTILHFQLRNLVWATSKHDVYLNSNYSVVHWSSLT GRRSEVLNLAGHVAPNEKHPGSLLEGFTQTQVSTLAVKD RFLVAGGFQGELICRFLDRPGISFCSRTTYDDNAITNAV EIYVSPSGGIHFIASNNDCGVRDFDM<u>ENFELSKHFRFPW PVNHTSLSPDGRLLVIVGDDPEGILVDAKTGRTIMPLRG HLDFSRASEWHPDGVTFATGNQDKTCRIWDIRNLSKSIA VLKGNLGAIRSIRYTSDGRYMAIAEPADFVHVYDTKTGY</u> KKEQEIDFFGEISGNSFSPDTESLFIGVWDRTYGSLLEY GRRRNFSYLDCLV |
| 108 | The amino acid sequence of SEQ ID 374. The conserved G-protein beta WD-40 repeat domains are underlined and the splicing factor motif is in bold. | MGVEEDLEDLNALAESTDAAVDGQAALASAVDSVTLQPA PPILPPVIPPPAVPVVAPVPTIPPVLRPLAPLPIRPPVL RPPAPRRDEAGSSDSDHDGTAAGSTAEYEITEESRLV RERHERANQDLMMRRRGAALAVPTNDKAVEARLRRLGEP MTLFGEREMERRPDRLRMLMAKDAEGGQLEKUQRAHEDEE AAASAAPEDVEEEMLQYPFYTEGSRALFNARIDIARFSI TRAALRLERARRRRDDPDEDVDAEIDWALKKAESLSLHC SEIGDDRPLSGCSFSHDGRLLATCSNSGVAKLWDTCRNP QVNRVLTLKGHTERATDVAFSPVQNH<u>IATASADRTAKLW NTEGTILKTFEGHLDRLGRIAFHPSGKY</u><u>LGTTSFDKTWR LWDI</u>ESGEELLLQEGHSRSIYGIDFHRDGSLVASCGLDA LARVWDLRTGRSILALEGHVKPVLGVSFSPNGYH<u>LATGG EDNTCRIWDLRKKKSLYTI</u>PAHANLISEVKFEPQEGYFL VTASYDTTAKVWSARDFKPVKTLSVHEAKITSVDITADA SHIVTVSHDRTIKLWTSNDDVKEQAMDVD |
| 109 | The amino acid sequence of SEQ ID 375. The conserved G-protein beta WD-40 repeat domains are underlined, and the conserved Dip2/Utp12 domain is in bold. | MVKAYLRYEPAAAFGVIASVESNIAYDASGKHLLAPALE KVGVWHVRQGVCTKALAPSASSAAGPSLAVTAIASSPSS <u>LIASGYADGSIRIWD</u>FEKGSCETTLNGHKGAVSVLRYGK LGSL<u>LASGSKDNDIILWD</u>VVGETGLYRLRGHRDQVTDLV FLDSDKK<u>LVSSSKDKYLRVWDL</u>ETQHCMQIVGGHHSEIW SLDTDPEERYLVTGSADPELRFYTVRNDSSDERSEADAS GGVGNGDLASHNKWDVLKQFGEIQRQSKDRVATVRFNKN GNLLACQAAGKLVEVFRVLDEAEAKRKAKRRLHRKREKK GADVNENGDSSRGIGEGHDTMVTVADVFKLLQTIRASKK ICSISFCPVAPKSSLATLALSLNNNLLEFHSIEADKTSK MLTIELQGHRSDVRSVTLSSDNTLLMSTSHNSVKIWNPS TGSCLRTIDSGYGLCGLIVPQNKHALIGTKDGAIEIFDV GSGTCIEVVEAHGGSIRSIVAIPNQNGFVTGSADHDIKF WEYGMKQKPGDNSKHLTVSNVRTLRMNDDVLVVAVSPDA QKIAVALLDCTVKVFFNDSLKLMHSLYGHRLPVLCLDIS SDGDLIVTGSADKNLMIWGLDFGDRHKSIFAHGDSIMAV QFVGHTHYNFSVGKDRLVKYWDADKFELLLTLEGHHADI WCLAISNRGDFLVTGSHDRSIRRWDRTEEPFFIEEEKEK RLEEMESDLDNAPGNKYVPKflEIPEEGAVALAGKKTQE TLSATDSIIEALDIAEELKRIAEHEEEIQINGKTAEFHP NYVNLGLSPSDFILRALSNVQTNDLEQTLLALPFSQALK LLSYLKDWTTYPDKVELVSRIATVLLQTHYNQLVSTPAA RPLLTTLKDILHKKVKECKDTIGFNLAANDHLKQLMALR SDALPQDAKVKLLEIRSQLSKRLEERTDPREAKRRKKKQ KKSTNMHAWP |
| 110 | The amino acid sequence of SEQ ID 376. The conserved G-protein beta WD-40 repeat domains are underlined. | MGGVQAEREDKDKVSLELTEEILQ<u>SMEVGMTFRDYSGRI SSMDFHRASSYLVTASDDESIRLYD</u>VASATCLKTINSKK YGVDLVSFTSHPMTVIYSSKNGWDESLRLLSLH<u>DNKYLR YFRGHHDRVVSLSLCPRNECFISGSLDRTVLLWD</u>QRAEK CQGLLRVQGRPATAYDDPGLVFAIAFGGCVRMFDARKYE KGPFEIFSVGGDVSDANVVKFSNDGRLMLLTTTDGHIHV LDS<u>FRGTLLYTFNVKPTSSKSTLEASFSPEGMFVISGSG</u> |

TABLE 11-continued

Annotated Peptide Sequences of the Present Invention.

| Entry | Sequence Description | Annotated Peptide Sequence |
|---|---|---|
| | | DGSVYAWSVRGGKEVASWLSTDTEPPVIKWAPGRLMFAT GSSELSFWIPDLSKLGAYVGRK |
| 111 | The amino acid sequence of SEQ ID 377. The conserved G-protein beta WD-40 repeat domains are underlined. | MAAFGAAPAGNHNPNKSSEVIQPPSDSVSSLCFSPRANH LVATSWDNQVRCWELTKNGASVTSVPKASMSHDQPVLCS AWKDDGTTVFSGGCDKQAKMWSLMSGGQPVTVAMHDAPI KEIAWIPEMNVLVTGSWDKTLKYWDTRQSNPVHTQQLPE RCYAMTVRYPLMVVGTADRNLIVFNLQNPQAEFKRFSSP LKYQTRCVAAFPDQQGFLVGSIEGRVGVHHLDDSQISKN FTEKCHRDNNDIYSVNSLNFHPVHHTFATAGSDGTFNFW DKDSKQRLKAMSRCSQPIPCSTFNNDGTIYAYSVCYDWS KGAENHNPATAKTYIFLHLPQESEVKAKPRVGTTNRK |
| 112 | The amino acid sequence of SEQ ID 378. The conserved G-protein beta WD-40 repeat domains are underlined. | MNCSISGEVPEEPVVSTKSGHVFERRLIERYVSDYGKCP VSGEPLTMDDVLPVKMGKIVKPRPLQAASIPGLLSIFQN EWDSLMLSNFALEQQLHTARQELSHALYQHDAACRVIAR LKKERDEARSLLALAERQIPMTASSDIAVNAPAMSNGRK ASLDEEPGYAGKKMRPGISASIIAEITDCNLALSQQRKK RQIPSTLAPVEDLERYTQLSSYPLHKTGKPGITSLDICH SKDIIATGGIDTSAVLFDRSSGQIMSTLSGHSKKVTSVN FDAQGDMVLTGSADKTVRIWQGSEDGSYNCRHILKDHTA EVQAITVHATNNYFATASLDNTWCFYEFSTGLCLTQVEG ASGSEGYTSAAFHPDGLILGTGTSNADVKIWDVKTQANV TTFSGHTGAITAISFSENGYFLATAAQDGVKLWDLRKLK NFRTFSAYDKDTGTNSVEFDHSGCYLGLAGSDIRVYQVA SVKSEWNCVKTFPDLSGTGKVTCVKFGPDSKYIAVGSMD HNLRIFGLPSEDGAMES |
| 113 | The amino acid sequence of SEQ ID 379. The conserved G-protein beta domain is underlined and the WD-40 repeat domains are in bold | MAAPGVETLKKEIKELKEKIAQHRLDTDGEQPLPAAAKS KSVPEVSAALKQRRILKGHFGKIYALHWSADSRHLVSAS QDQIRIIWNGFTTNKVHAIPLRSSWVMTCAYSPSGNLVA CGGLDNLCSVYKVPHGGNKESSSAQKTYCELAQHEGYLS CCRPIIRNEIVTSSGDSTCILWDVETKTPKAIFNDHTGD VMSLAVFDDKGVFVSGSCDATAKLWDHRVHKQCVHTFQG HESDINSVQFFPDGDAFGTGSDDSSCRLPDIRAYQQINK YSSDKILCGITSVAFSKTGKSLFACYDDYNTYVWDTLSG NQVEVLTGHENRVSCLGVSEDGKALATGSWDTLLKIWA |
| 114 | The amino acid sequence of SEQ ID 380. The conserved G-protein beta WD-40 repeat domains are underlined. | MGGVEDESEPASKRMKLSSRVLRGLANGSSRTEPAAGSS LDLMARPLPIEGDEEVIGSKGVIKRVEFVRLIAKALYSL GYEKSGARLEEESGIPLQSSVVNLFMQQISDGLWDESVV TLHKIGLSDENLVKSASFLILEQKFLELLDQEKANDALK TLRTEITPLCIKNSRVRELSSCIISPSSCGLLNQNKRNS TRARSRSELLEELQKLLPPAVIIPERRLEHLVEQALVLQ TDACMLHNSIDMEMSLYTDHQCGKEHIPCRTLQILQSHN DEVWLVQFSHNGKYLASASNDRSAIIWEVDENGSVSLKH KLTGHQKPISSVCWSPDDRQLLTCGVGETVRRWDVSSGE CLRVYEKAGHGLISCAWFPDGKWICYGVSDRSICMCDLE GKEIECWKGQRTLSISDLEITSDGKQIISICRETAILLL DREARYERNIEENQTITSRSLSKDNRYLLVNLLNQEIHL WDIKGDFRLVAKYKGLKRSRFVIRSCFGGLKQAFVASGS EDSQVYIWHKGSGELIEPLPGHSGAVNCVSWNPANHHML ASASDDRTIRIWGLNELNTRHKGARPNGVHYCNGNGTS |
| 115 | The amino acid sequence of SEQ ID 381. The conserved G-protein beta WD-40 repeat domains are underlined. | MTQLAETYACMPSTERGRGILIAGNPKPGSNSVLYTNGR SVVILNLDNPLDISVYAEHAYPATVARFSPNGEWVASAD SSGAVRIWGAYNDHVLKKEFKVLSGRIDDLQWSPDGLRI VASGDGKGKSLVRAFMWDSGTNVGEFDGHSRRVLSCAFK PTRPFRIVTCGEDFLVNFYEGPPPFKFKLSRRDHSRFVNC LRFSPDGNRFISVSSDKKGIIYDGKTGEKIGELSSDGGH TGSIYAVSWSPDSKQVITVSADKSAKIWDISEDGSGNLR KTLTSSGSGGVDDMLVGCLWQNNHLVTVSLGGTISIYTA GDLDKAPVSFSGHMKNVSSLSVLKGDPKVILSSSYDGLI IKWIQGIGFSGRVQRKESTQIKCLAAVDEEIVTSGYDNK VCRVSGSGDAEFIDIGCQPKDLSLALQCPEFALVSTDTG VVLLRGAKIVSTINLGFAVTASTVAPDGTEAIIGAQDGK LRIYSISGDTLTEEAVLEKHRGAISVIHYSPDLSMFASG DLNREAVVWDRASREVRLKNILYHTARINCLAWSPDSST VATGSLDTCVIIYEVDKPASNRLTIKGAHLGGVYGLAFT DDFSVVSSGEDACIRVWKINRQ |
| 116 | The amino acid sequence of SEQ ID 382. The conserved G-protein beta WD-40 repeat domains are underlined and the SOF1 protein | MKVKVISRSTDEFTRERSQDLQRVFRNFDPNLRTQEKAV EYVRALNAAKLDKVFARPFVGANDGHVDSVSCMAKNPNY LKGIFSGSMDGDIRLWDIASRRTVCQFPGHQGPVRGLAA STDGQILVSCGIDSTVRLWNVPATLGESDGTHENLAKP |

TABLE 11-continued

Annotated Peptide Sequences of the Present Invention.

| Entry | Sequence Description | Annotated Peptide Sequence |
|---|---|---|
| | domain is in bold. | LAVYVWKNAFWAVDHQWDGELFATAGAQVDIWNQNRSQP ISSFEWGTDTVISVRFNPGEPNVLATSGSDRSITLYDLR MSSPTRKVIMRTKTNAISWNPMEPMNFTAANEDCNCYSY DARKLEEAKCVHKDHVSAVMDIDYSPTGREFVTGSYDRT VRIFQYNGGHSREVYHTKRMQRVFCVKFSCDASYVISGS DDTNLRLWKAKASEQLGVVULPRERRKHEYHEAVKSRYKH LPEVKRIVRHEHLPKPIYKAGILRRTVNEADERKEERPK AHSAPGSSSAEPLRKRRIIKEIE |
| 117 | The amino acid sequence of SEQ ID 383. The conserved G-protein beta WD-40 repeat domains are underlined. | MVRSIENPKKAKRRNKGSKNGDGSSSSSSIPSMPTKVWQ PGVDKLEEGEELQCDPSAYNSLHAFHIGWPCLSFDIVRD TLGLVRTEFPHQVYFVAGTQAERPTWNSIGIFKVSNITG KRRELVPSKPTDDADEESDSSDSDEDSDDEVGGSGTPIL QLRKVGHEGCVNRIRAMNQWPHICASWGDSGHVQIWDFS SHLNALAESEADVSQGASSVFNQAPLVKFGGHKDEGYAL DWSPLVPGRLVSGDCKNSIHLWEPTSGS<u>TWNVDSTPFIG HAASVEDLQWSPTEENVFASCSVDGTIAIWDTRLGKTPA ASFKAHDADVNVISWNRLATCMLASGCDDGTFSIHDLRL LKEGDSVVAHFEYHKHPVTSIEWSPHEASTLAVSSADCQ LTIWDL</u>SLEKDEEEEAEFKAKTKEQVNAPEDLPPQLLFV HQGQKDLKELHWHAQIPGMIVSTAADGFNILMPSNIQST LPSDGA |
| 118 | The amino acid sequence of SEQ ID 384. The conserved eukaryotic protein kinase domain is underlined and the protein kinases ATP-binding region and serine/threonine protein kinases active-site signatures are in bold. | MERY<u>KVIKELGDCTYGSVWKALNQQTHEIVAIKKMKRKY YIWEECINLREVKSLRKLNHPNIIKLKEVIRENNELFFI FEYMECNLYQIMKERSTFFSETAIIKFCYQILQGLSYMH RNGYFHRDLKPENLLVTSDLIKIADFGLAREVLTSPPYT DYVSTRWYRAPEVLLQSPTYTTAIDMWAVGAILAELFTL HPLFPGESELDEIYRICGVLGTPDYETWPDGMQLAAFRN FIFPQFLPVNLSVLIPHASPEAIDLITRLCSWDPQKRPT AEQALHHPFFRIGMSIPLSLGGHFQDNTCAAEVDTKFHS</u> KKACKAWNGEKESSLECFLGLSLGLKPSLGHLGAMGSQG VGAVKQEVGSSPGCQSNPKQSLFQVLNSRAILPLFSSSP NLNVVPVKSSLPSAYTVNSQVMWPTIAGPPAAAVTVSTL QPSILGDFKIFGKSMGLASQYAGKEASPFS |
| 119 | The amino acid sequence of SEQ ID 385. The conserved eukaryotic protein kinase domain is underlined and the protein kinases ATP-binding region and serine/threonine protein kinases active-site signatures are boxed in bold. | MGEMGRGINNSSNNNNSNRPAWLQHYDLVGKIGEGTYGL VFLARSKLPNNRGLRIAIKKFKQSKDGDGVSPTAIREIM LLREFSHENVVKLVNVHINHVDMSLYLAFDYAEHDLYEI IRHHREKLNHHNINQYTVKSLLWQLLNLGLNYLHSNWIVH RDLKPSNILVNGEGEEHGVVKIADFGLARIYQAPLKPLS DNGVVVTIWYRAPELLLGAKHYTSAVDMWAVGCIFAELI TLKPLFQGVEVKASPNPFQLDQLDKIFKVLGHPTIEKWP TLMNLPHWSKNLQQIQQHKYDNAGLHIGPIPAKSPAYDL LSKMLEYDPRKRITAAQALEHEYFRIDPQPGRNALVPSQ PGEKAINYPPRLVDANTDFDGTIAPQPSQVSSGNAPSGS IASAAVPAVRPLPQQMQLMGMQRMQNPGMAAFNLGAQAS MSGLNHNNIALQRGSSQQQAHQQVRRKEPNSGFPNTGYP PPPKSRRL |
| 120 | The amino acid sequence of SEQ ID 386. The conserved protein kinase family domain is underlined. The protein kinases ATP-binding region is in bold and the serine/threonine protein kinases active-site signature is in bold/italics. | MDKYEKLEKVGECTYGKVYKARDKMTGQLVALKKTRLEM DEEGVPPSSLREISLLQMLSQSIYVVRLLCVEHVTKKGK PLLYLVFEYLDTDLKKFIDYRRSVNAGPLPQNVIQSFMY QLLKGVAHCHSHGVLHRDLKPQNLLVDKSKGLLKVGDLG LGRAFTVPLKCYTHEVVTLWYRAPEVLLGSTHYSTPVDI WSVGCIFAEMVRRQPLFPGDCEIQQLLHIFTLLGTPTEE MWPGVKRLRDWHEYPQWKPENLARAVPNLSPTGLDLISK MLQCDPARRISAKAAMNHPYFDDLDKSQF |
| 121 | The amino acid sequence of SEQ ID 387. The conserved protein kinase family domain is underlined. The protein kinases ATP-binding region is in bold and the serine/threonine protein kinases active-site signature is in bold/italics. | MDGYEKNDKVGEGTYGKVYMAPDKKTGQLVALKKTRLEN DEGIPPTALREISLLQMLSQDIYIVRLLDVKHTENKLG KPLLYLVFEYMESDLKKYIDSYRRSHTKNPPSMIKSFMY QLCRGVAYCHSRG*VMHRDLKPHNLLV*DKEKGVLKIADLG LSRAFTVPVKKYTHEIVTLWYRAPEVLLGATHYSLPVDI WSVGCIFAEMSRMQALFTGDSEVQQLMNIFRFLGTPNEE VWPGVTKLKDWHIYPEWKPQDISHAVPDLEPSGLDLLSQ MLVYEPSKRISAKKALEHPYFDDLDKSQF |
| 122 | The amino acid sequence of SEQ ID 388. The conserved eukaryotic protein kinase domain is underlined and the protein kinases ATP-binding region and serine/threonine protein kinases | MDAYEKLEKVQEGTYGKVYKAKDKNTGQLVALKKTRLES DDEGIPPTALREISLLQMLSQDIHIVRLLDVEHTENKNG KPLLYLVFEYMDSDLKKYIDGYRRSHTRVPPNIIKSFMY QLCQGVAYCHSRGVMHRDLKPHNLLVDKQRGVVKIADLG LGRAFTIFIKKYTHEIVTLWYRAPEVLLGATHYSTPVDI WSVGCIFAEMVRLQALFIGDSEVQQLFKIFSFLGTPNEE |

TABLE 11-continued

Annotated Peptide Sequences of the Present Invention.

| Entry | Sequence Description | Annotated Peptide Sequence |
|---|---|---|
| | active-site signatures are in bold. | IWPGVTKFRDWHIYPQWKPQDISSAVPDLEPSGVDLLSK MLVYEPSKRISAKKALEHPYFDDLDKSQF |
| 123 | The amino acid sequence of SEQ ID 389. The conserved protein kinase family domain is underlined. The protein kinases ATP-binding region is in bold and the serine/threonine protein kinases active-site signature is in bold/italics. | MDSYEKLEKVGEGTYGKVYKAKDKKTGKLVALKKTRLEN DGEGIPPTALREISLLQMLSQDMNIVRLLDVEHTENKNG KPLLYLVFEYMDSDLKKYVDGYRRSHTKMPPKIIKSFMY QLCQGVAYCHSRG*VMHRDLKPHNLLV*DKQRGVLKIADLG LGRAFTVPIKKYTHEIVTLWYRAPEVLLGATHYSTPVDI WSVGCIEAEMSRMHALFCGDSEVQQLMSIFKFLGTPNEG VWPGVTKLKDWHIYPEWRPQDLSRAVPDLEPSGVDLLTK MLVYEPSKRISAKKALQHPYFDDLDRSQF |
| 124 | The amino acid sequence of SEQ ID 390. The conserved eukaryotic protein kinase domain is underlined and the protein kinasas ATP-binding region and serine/threonine protein kinases active-site signatures are in bold. | MEKYEKLEKVGEGTYGKVYKGRDKRTGRLVALKKTPFHQ EEGIPPTAIREISLLKSLSQCIYIVKLLDVKASFNGKGK HVLFMVFEYADSDLKKHIDAHRQCNTKLSPRSIQSYMFQ LCKGIAYCHSHGVLHRDLKPQNILVDQKIGLLKIADLGL GRACTVPIKSYTFEVVTLWYRAPEVLLGAKRYSMALDIW SLGCIFAELCNLQALFAGDSQIQQLINIFRLLGTPNEQL WPGVTQLSDWHEFPQWRPQDLSKVVFNLDPNGVDLLSKM LQYDPARRISAKEALDHPYFDSLDKSQF |
| 125 | The amino acid sequence of SEQ ID 391. The conserved eukaryotic protein kinase domain is underlined and the serine/threonine protein kinases active-site signatures are in bold. | MGCVCGKPSARAADYVESPAEKGASSNSRSSSMASRRLV APAVMDQGIDAENGHEGDYRTKLRGKQSNGADPVSLLSD DAEKQRHSRHHQHQQHHPIRPHHLRPQGEFVPNANSNPR FGNPPRHIEGEQVAAGWPAWLTAVAGEAIKGWIPRRADS FEKLDKIGQGTYSNVYKARDLDTGKIVALKKVRFDNLEP ESVRFMAREIQVLRRLDHPNVVKLEGLVTSRMSCSLYLV FEYMDHDLAGLAACPGIKFTEPQVKCYMQQLLRGLDHCH SRGVLHPDIKGSNLLIDNGGILKIADFGLATFFHPDQRQ PLTSRVVTLWYRPPELLLGATEYGVAVDLWSTGCILAEL LAGKPIMPGRTEVEQLHKIFKLCGSPSEDYWKKSKLPHA TIFKPQQPYKRCVAETFKDFPPSALALMEVLLAIEPADR GTATSALKSDFFTTKPLACDPSSLPKYPPSKEFDAKIRD EEARRQRAAGGRGRDAARRPSRESRAIPAPEANAELAIS IQKRRLSSQGPSKSKSEKFNPQQEDGAVGFPIEPPRPMH IGIDAGATSRMYSQQFGPSHSGPLSNQISSSIWGKNQKE DEIQMAPGRPSRSSKATISDFRKPGACAPQPGADLSHLS SLVATARSNAGIDTHKDRSGMWQHNRIDAIDGVHNNGKH EFLEVPEHPNRQDWTRFQQPESFKGLDNYHLQDLPATHH RKDERVASKEATMNWQGYGGQGGDKIHYSGPLLPPSGNI DEILKEHERHIQHAVRRARQDKGRPQRSNLSQNERKAFE HRSFVSGVNGNAGYSDLVNELPISVGSNRLKVSKTRGTE EIVELRELEREPLSSVMEKYEREHEM |
| 126 | The amino acid sequence of SEQ ID 392. The conserved eukaryotic protein kinase domain is underlined and serine/threonine protein kinases active-site signatures is in bold. | MGCVCAKQSDILGEPESPKVKGSNLASSRWSVSSETKQL PQHSDSGILHHQHYYHPRDESDEAKLKESNYGGSKRRTR QGRDPADLDMGIFVRTPSSQSEAELVAAGWPAWMAAFAG EAIHGWIPRRAESFEKLYKIGQGTYSNVYKARDLDNGKI VALKKVRFDSLDAESVRFMAREILVLRKLDHPNIVKLEG LVTSEVSSSLYLVFEYMEHDLAGLAACPGIKFTEPQVKC YMQQLLQGLDHCHRHGVLHRDIKGSNLLIDNGGILKIAD FGLATFFYPDQKQLLTSRVVTLWYRPPELLLGATDYGVA VDIWSAGCILAELLAGKPILPGRTEVEQLHKIFKLCGSP SEDYWKESKLPHATIFKPQHPYKSCIAEAFKDFSPSALA LLETLLAIEPGHRGEASGALKSEFFTTEPLSCDPSSLPK YPPSKEFDAKLRAQETRRQRDVGVRGHGSEAARRTSRLS RAGPTPNEGAELTALTQKQHSTSHATSNIGSEKPSTKKE DYTAGLHIDPPRPVNHSYETTGVSRAYDAIRGVAYSGPL SQTHVSGSTSGKKPKRDHVKGLSGQSSLQPSKPFIVSDS RSERIYEKSHVTDLSNHSRLAVGRNRDTTDPHKSLSTLM QQIQDGTLDGIDIGTHEYARAPVSSTKQRSAQLQRPSAL KYVDNVQLQNTRVGSRQSDERPANKESDMVSHRQGQRIN CSGPLLHPSANIEDLLQKHEQQIQQAVRRAHHGKREALS NKSSLPGKKPVDHRAWVSSGKGNKESPYFKGKGNKELSD LKGGPTAKVTNFRQKVM |
| 127 | The amino acid sequence of SEQ ID 393. The conserved protein kinase family domain is underlined. The protein kinasas ATP-binding region is in bold and the serine/threonine protein kinases active-site signature is in bold/italics. | MAVANPGQLNLQEAPSWGSRSVNCFEKLEQIGEGTYGQV YMAKEIETGEIVALKKIRMDNEREGFPITAIREIKLLKK LQHENVIKLKEIVTSPGPEKDEQGKSDGNKYNGSIYMVF EYMDHDLTGLAERPGMRFSVPQIKCYMKQLLIGLHYCHI NQ*VLHRDIKGSNLLI*NNGILKLADFGLARSFCSDQNGN LTNRVITLWYRPPELLLGSTKYGPAVDMWSVGCIFAELL YGKPILPGKNEPEQLTKIFELCGSPDESNWPGVSKLPWY SNFKPQRQMKRRVRESFKNFDRHALDLVEKMLTLDPSQR ISAKDALDAEYFWTDPVPCAPSSLPRYEPSHDFQTKRKR |

TABLE 11-continued

Annotated Peptide Sequences of the Present Invention.

| Entry | Sequence Description | Annotated Peptide Sequence |
|---|---|---|
| | | QQQRQHDEMTKRQKISQHPPQQHVRLPPIQNAGQGHLPL RPGPNPTMHNPPPQFPVGPSHYTGGPRGAGGQNRHPQNI RPLHAAQGGGYNANRGYGGPPQQQGGGYPPHGMGNQGPR GGQFGGRGAGYSQGGPYGGPVGGRGPNVGGGNRGPQFWS EQ |
| 128 | The amino acid sequence of SEQ ID 394. The conserved eukaryotic protein kinase domain is underlined and the serine/threonine protein kinases active-site signature is in bold. | MQNMEDNVQSSWSLHGNKEICARYEILERVGSGTYSDVY RGRRKADGLIVALKEVHDYQSSWREIEALQRLCGCPNVV RLYEWFWRENEDAVLVLEFLPSDLYSVIKSGKNKGENGI PEAEVKAWMIQILQGLADCHANWVIHRDLEPSNLLISAD GILKLADFGQARILEEPEAIYEVEYELPQEDIVADAPGE RLMEEDDSVKGVRNEGEEDSSTAVETNFGDMAETANLDL SWKNEGDMVMQGFTSGVGTRWYRAPELLYGATIYGKEID LWSLGCILGELLILEPLFSGTSDIDQLSRLVKVLGTPTE ENWPGCSNLPDYRKLCFPGDGSPVGLKNHVPSCSDSVFS ILERLVCYDPAARLNAKEVLENKYFVEDPYPVLTHELRV PSPLREENNFSEDWAKWKDMEADSDLENIDEFNVVHSSD GFCIKFS |
| 129 | The amino acid sequence of SEQ ID 395. The conserved eukaryotic protein kinase domain is underlined and the protein kinases ATP-binding region and serine/threonine protein kinases active-site signatures are in bold. | MDLNQYPEDLNPELPEGTDNVDNPDNNKGSPVPSPHPPL KPLDPSER<u>YRKGITLGQGTYGIVYKAFDTVTNKTVAVKK IHLGKAKEGVNVTALREIKLLKELSHPNIIQLIDAYPHK QNLHIVFEFNETDLEAVIKDRNLVFSPADIKSYLQMTLK GLAVCHRKWVLHPDMKPMNLLIAADGQLKLGDFGLARLF GSPDRKFTHQVFAVWYRAPELLFGAKQYGPAVDIWATGC IFAELLLRKPFLQGVSDLDQIGKIFAAFGTPRQSQWPDV ASLPDFVEFQFVPAPSLRSLFPMASEDALDLLSKMFTLD PKNRITAQQALEHRYFSSVPAPTRPDLLPKPSKVDSSRP</u> PKHASPDGPVVLSPSKARRVMLFPNNLAGILPKQVSQST TGGTPIEFDMPTQKLREVCPRSRITESGKKNLRKTMDM SAALDECAREQEGQEGKTILDPDHQRSAKKEKHM |
| 130 | The amino acid sequence of SEQ ID 396. The conserved cyclin N- and C-terminal family domains are underlined. | MAGGQENCVRITRARAACVSKASAPVIQSQVDEKKSRKR APKRAAVDDLAANASGSQPKRRAVLGDVTNLHAAATDCL STAEDQVDAPNPSIKGRARNKKKEARTSTKVVKDEIHPE SNPLADHSSNLSECQKPPAAKLAEQRSLRGVPSKAKQGG SSNSQSCSKHTDIDKDHTDPQMCTTYVED<u>IYEYLRNAEL KNRPSANFMETAQNDITPNMRAILVDWLVEVSEEYKLVP DTLYLTVSYIDRYLSANPTSRHKLQLLGVSCMLIASKYE EVCPPHVEEFCYITDNTYTRDENLSMERKILIFLNFEMT KPTTKSFLRRFVRASQAGNKAPSLHMEFLANYLAELTLM ECSFLQYLPSLIAASTVFLSRLTLDFLTNPWNPTLAHYT GYKASQLKDCVMAIYNVQMNRKGSTLVAIREKYQQHKFK CVASLPPPPFIAERFFEDTPN</u> |
| 131 | The amino acid sequence of SEQ ID 397. The conserved cyclin and cyclin C-terminal domains are underlined and the cyclins signature is in bold. | MTGTQASNVRITRARAAKSTLNNALPPLPPAQGKPRGKR AATESNISGFSVAAEPLKRRAVLSDVSNICKEAAAVDCL KKPKAVKVVSQNANAKGRGRGIPRNNKKITQEAEIKKET SPAICNVDDASAGNAIGDDKQNNNVNPLKEVQDNPKELN PIAEQISVHPCEQSVEKPNEKEIVVSDNKAAIASLKQQ STLQSLRIPKQPKYSLKQGNPVPLANLHEDVGRSSCSDF IDIDSEYKDPQMCTAYVT<u>DIYANMRVVELKRRPLPNFME TTQRDINANMRSVLIDWLVEVSEEYIRVPDTLYLTVSYI DRFLSANVVNRQRLQLLGVSCMLVASKYEEICAPPVEEF CYITDNTYKKEEVLEMEISVLNRLQYDLTTPTTKTFLRR FIRAAQASCKVSSLHLEFMGNYLAELTLVEYDFLKYLPS LIAAAAVFVARNTLDPNVHPWNSTLQHYTGYKVSDMRDC ICAIHDLQLNRKGCTLAAIREKYNQPKFKCVANLFPPPI ISPQFLIDNEV</u> |
| 132 | The amino acid sequence of SEQ ID 398. The conserved cyclin and cyclin C-terminal domains are underlined and the cyclins signature is in bold. | MAAPNQNALLINNNNRRPLVDIGNLVGALNAQCNISKNG ARKRAFGDIGNLVEDLDAKCTISKYWVRKRPRTNFGVNA NKGASSSTQGQGIVVRGEQKAWDRIVWGNKQSCAIKMNA QHVTATQRGTAISISDIIDSSVQDGGIKAPSQLKARKQT VRTVTATLTARSEDSLRDVLEVPPGIDDGDRDNPLAVVE YVE<u>DIYHFYRKIEVRSCVPPDYMTRQLEIKDSNRGVIID WLIEVHRTFLLMPETLYLTVNIIDRYLSIQSVTRNELQL MGITANFIASKYEEISPPKINDLVYITKDAYTSKQIVNM EHTILNRLRFKLTVPTPYVFLVRFLKAAGPDKVMKNLAF FLVDLCLLHYKMIKYSPSMLAAAAVYTAQCTLKKHPYWN ETLILHIGYSEAHLRECAHLMADLHLKAEGSNLKSVYKK YSYPIFGSVAFLSPAKIPAGTVAAPAIDKCAHQIYLRNL R</u> |

TABLE 11-continued

Annotated Peptide Sequences of the Present Invention.

| Entry | Sequence Description | Annotated Peptide Sequence |
|---|---|---|
| 133 | The amino acid sequence of SEQ ID 399. The conserved cyclin N- and C-terminal family domains are underlined. | MFPNKQTQGLVQNKKMASKAAQPKAMVPPQRVPPAANNR RALGDIGNIVADVGGKCNVTKDGVNGKPLAQVSRPITRS FGAQLLAQAAANKGISAANNQTQVPVVIPKADVRGNRQR RTSKSKDIPPTTVVTNESDDCVIIEQAQRIKPTCNHNVG AVGNKEKPQLLTAKPKSLTASLTSRSAVALRGFRPDDEM TEAEEDPLPNIDVGDRDNQLAVVEYVE<u>DIYKFYRRTEQM SCVPDYMPRQQEINPKMRAVLINWLIEVHYRFGLNPETL YLTTNLIDRYLATQLVSRSNYQLVGATANLLASKYEEIW APEMNDFLDILENKFERKHVLVNEKANLNKLKFHLTVPT PYVFLVRFLKAAASDEEMENLVFFLMELSLMQYVMIKFP PSMLAAAAVYTAQITLKKTTVWNDVLKRHTGYSEIDLKE CTRLMVAFHQSSEESKLNVVFKKYSMPEYDSVALIKPAK LPA</u> |
| 134 | The amino acid sequence of SEQ ID 400. The conserved cyclin and cyclin C-terminal domains are underlined | MAPSFDCVANAYIESCEDQEKLRQNAQILAQSGENDVDE <u>PVSMLVQRETHYMLPEDYLQRLRNRTLDVNVRREAVGWI LKVHSFYNFGAPTAYLAVNYLDRFLSRHRMPQGVKAWMI QLMAVACLSLAAKMEETQVPLPSDLQREDARFIEDARTI QRMELLILSTLQWGMRS</u>ITPFSFIDYFAYRAVQGHGHGH DATPKAVMSRAIELILSTTEEIDFMEYRPSAIAAAALLC AAEEVVPLQAVHYKRALSSSITDVDKDKNFGCYNLIQET IIEGGCYWTPMSLQSTEKTPVGVLDAAACLSNTPTSSYS VKPYASVTAAKRRKLNEICSALLVSQAHPC |
| 135 | The amino acid sequence of SEQ ID 401. The conserved cyclin and cyclin C-terminal domains are underlined. | MAANFWTSSHCKELLDAEKVGIVHPLDRDQGLTQEDVKI IKINMSNCIRTLAQYVKLRQRVVATAITYCRRVYTRKSF <u>TEYDPQLVAPTCLYLASKAEESTVQAKLVIFYMKKYSKH RYEIKDMLEMEMKLLEALDYYLVIYHPYRPLIQFLQDAG LNDLKVTAWALVNDTYRTDLILTYPPYMIALACIYFACI MEEKDAQAWFEELRVDMNEIKNISMEIVDYYDNYRVIPD EKNNSALNKLPHRF</u> |
| 136 | The amino acid sequence of SEQ ID 402. The conserved cyclin domain is underlined. | MAPALSSSYECLSHLLCAEDASNVVGCWDEDESKIFCEE EEGFGIQHFPDFPVPDD<u>DEIRVLVRKESQYMPGKSYVQS YQNLGLOFTARQNAIGWILKVHGSYNFGPLTAYLSINYL DRFLSRNPLPEAKVWMLQLLSVACLSLAAKMEETQVPLL LDLQAEEPDFLFEPRTIQRMELLVLSTLEWRMLSVTPFS FVDYFLQGGGGRKPPPRAMVARANELIFNTHTVLDFLEH RPSAIAAAAVICAAEEVLPLEAAQYKETILSCSLVDKEW VFGSYNLIQEVLIEKFSTPKKAKSASSSIPQSPVGVLDA FCLSNNSNNTSLEASLSVNLYASVAAKRRKLNDYCNTWR MFQHSTC</u> |
| 137 | The amino acid sequence of SEQ ID 403. The conserved cyclin domain is underlined. | MAPNCIDCAPSDLFCAEDAFGVVEWGDAETGSLYGDEDQ LHYNLDICDQHDEHLWDD<u>GELVAFAEKETLYVPNPVEKN SAEAKARQDAVDWILKVHAHYGFGPVTAVLSINYLDRFL SANQLQQDKPWMTQLAAVACLSLAAKNDETEVPLLLDFQ VEEAKYIFESRTIQRMELLVLSTLEWRMSPVTPLSYIDH ASRMIGLENHHCWIFTMRCKEILLNTLRDAKFLGLLPSV VAAAIMLHVIKETELVNPCEYENRLLSAMKVNRDMCERC IGLLIAPESSSLGSFSLGLKRKSSTINIPVPGSPDGVLD ATFSCSSSSCGSGQSTPGSYDSNNSSILCISPAVIKKRK LNYEFCSDLHCLED</u> |
| 138 | The amino acid sequence of SEQ ID 404. The conserved cyclin-dependent kinases regulatory subunit domain is underlined and the cyclin-dependent kinases regulatory subunits signature 1 is in bold. | <u>MPQIQYSEKYTDDTYEYRWJVLPPETAKLLPKNRLLNEN EWRAIGVQQSRGWVHYAIHRPEPHIMLFRRPLNYQQNQQ QQAGAQSQPMGLKAQ</u> |
| 139 | The amino acid sequence of SEQ ID 405. The conserved cyclin-dependent kinases regulatory subunit domain is underlined and the cyclin-dependent kinases regulatory subunits signature 1 is in bold. | <u>MDQIEYSEKYYDDTYEYRHVELPPDVARLLPKNRLLTEN EWRGIGVQQSRGWVHYAIHCSEPHIMLFRRPLNYEQNHQ HPEPHIMLFRRPLNCQPNHQPQAHHPT</u> |
| 140 | The amino acid sequence of SEQ ID 406. The conserved cyclin-dependent kinases regulatory subunit domain is underlined and | <u>MDQIEYSEKYYDDTYEYRHVELPPDVARLLPKNRLLTEN EWRGIGVQQSRGWVHYAIHCSEPHIMLFRRPLNYEQNHQ HPEPNIMLFRRPLNCQPNHQPQAHHPT</u> |

TABLE 11-continued

Annotated Peptide Sequences of the Present Invention.

| Entry | Sequence Description | Annotated Peptide Sequence |
|---|---|---|
| | the cyclin-dependent kinases regulatory subunits signature 1 is in bold. | |
| 141 | The amino acid sequence of SEQ ID 407. The conserved cyclin-dependent kinases regulatory subunit domain is underlined and the cyclin-dependent kinasas regulatory subunits signature 1 is in bold. | MPQIQYSEKYYDDTYEYRHVVLPPDVARLLPKNRLLNEN EWRGIGVQQSRGWVHYAIHRPEPHIMLFRRHLNYQQNQQ QQAQQQPAQAMGLQA |
| 142 | The amino acid sequence of SEQ ID 408. The conserved GCN5-related N-acetyltransferase family domain is underlined and the radical SAM family domain is in bold. | MALVETEPVTLIHPEEPRKFKKKPTPGRGGVISHGLTEE EARVKAIAEIVGANVEGCRKGEDVDLNALKAAACRRYGL SRAPRLVEMIAALPDGERAAVLPRLKARPVRTASGIAVV AVMSKPHRCPHIATTGNICVYCPGGPDSDFEYSTQSYTG YEPTSMRAIRARYNPYVQTRSRIDQLKRLGHTVDKVEFI LMGGTFMSLPADYPDYFIENLHDALSGHTSSNVEEAVCY SEHSATKCIGLTIETRPDYCLGPHLRQMLSYGCTPLEIG VQSTYEDVARDTNRGHTVAAVADCFCLAIWAGFKVVAHM MPDLPNVGVERDDNSFREFFENPAFRADGLRIYPTLVIR GTGLYELWKTGRYRNYPPEQLVDIIARVLALVPPWTRVY RVQRDIPMPLVTSGVERGNLRELALARMDDLGLKCRDVR TREAGIQDIHHKIRPEVVELVRRDYCANEGWETFLS<u>YED TRQDILVGLLRLRKCGHNTTCPELRGRCSIVRELHVYGT AVPVHGRDADRLQHQGYGTLLMEQAERIAWREHRSIKIA VISGVGTRHYYRKLGYELEGPYNMKYLN</u> |
| 143 | The amino acid sequence of SEQ ID 409. The conserved chromo domain is underlined and the MOZ/SAS-like protein domain is in bold. | MLGFRDLYTSICEHLQRASGRLPIIAAATSLISTPEIAA VERENKAPNSVDEMGMGSADESGRFSTSNGQFMNMNNGV VKEEWRGGVPVVPSAPTTVPVITNVKLETPSSPDHDMAR KRKLGFLPLEVGTRVLCKWRDG<u>KFHPVRIIERRKLPNGA TNDYEYYVHYTEFNRRLDEWVKLEQLELDSVETDADERV DDK</u>AGSLENTRHQKRKIDETHVEGNEELDAASLREHEEF TKVRNITRIELGRYEIETWYFSPFPSEYNNCEKLYFCEF CLNFMRRREQLQRHMRKCDLKHPPGDEIYRSGTLSMFEV DGKKNKVYAQNLCYLAKLFLDHKTLYYDVDLFLFYILCE CDERGCNMVGYFSKEKHSEESYNLACILTLPPYQRKGYG KFLISFSYELSKKEGKVGTFERPLSDLGLLBYRGYWTRV LLDILKKHKSNISIKELSDMTAIKADDVLSTLQGLDLIQ YRKGQHAICADPKVLDRHLKAVGRGGLEVDVCKLIWTPY KEQ |
| 144 | The amino acid sequence of SEQ ID 410. The conserved MOZ/SAS-like protein domain is underlined. | MGSLDESTCSEEIRDEGRDSIRTKFKVESTVNNAQNGGN DNSRRKRAAGLPLEVGIRLLCRWRDSKLHFVRIIERREL PNGFPQDYEYYVHYTEFNRRLDEWVKLEQFELDSVETDA DEKIEDKGGSLKNTRHQKRKIDEIHVEEGQGHEDFDPAS LREHEEFTKVRNIAKVELGRYEIETWYFSPFPPEYSHCE KLFFCEFCLNFMKRKEQLQRHNRKCD<u>LKHPPGDEIYRNG TLSMFEVDGKKNKIYGQNLCYLAKLFLDHKTLYYDVDLF LFYVLCECDDRGCHVVGYFSKEKHSDEAYNLACILTLPP YQRKGYGKFLIAFSYELSKKEGKVGTFERPLSDLGLLSY RGYWTRILLDILKKQRGNISIKELSDMTAIKVEDVISTL QVLDLIQYRKGQHVICAD</u>PKVLDRHLKAAGIAGLEVDVS KLIWTPYKEQCG |
| 145 | The amino acid sequence of SEQ ID 411. The conserved bromo family domain is underlined. | MASAFMVGCDDSRDKHRWVESKVYMRKGHGKGSKGNAGF NAQNSTAQVRRENDNMGNSIADNGKSEAASEGLSSLSRK QITVNQDHPPNETSSMPAVGGLQNIDTHVTFKLEGCSKQ EIWELRKKLTNELEQVRGTFKKLEARELQLRGYSVSAGV NTSYSASQFSGNDMRNNGGKEVTSEVASGGAITPKQAQR ESNPPRQLSISLNENNQAASDMGEKGKRTPRANQYYRNS EFVLGKDKFPPAESKKSKSTGNKKISQSKVFSKETMQVG KEFNFQKSVN<u>EVFKQCSLLLTKLMKHKYGWVFNLPVDAQ ALGLHDYHTIIKRPNDLGTVKSKLEKNLYNSPASFAEDV KLTFSNAMTYNPKGHEVHTMAEQLLQLFEERWKTIYEEH</u> LDGKMRFGSGQGLGASSSTKKLPFQDSKKNIKKSEPAGG PSPPKPKSTNHHASRTPSAKKPKAKDPHKRDMTYEEKQR LSTNLQNLPQERLELIVQIIKKRNPSLCQHDEEIEVDID SFDTETLWELDRFVTNYKKSLSRNKKKALLADQAKRASE HGSARNKHPMIGRELPNNNRKGEQGEKVVEIDHMPPVNP PVVEVEKDGVYARRSSSSSSSSSDSGSSSSDSDSGSSSG SESDAYAATSPPAGSNTSARG |

TABLE 11-continued

Annotated Peptide Sequences of the Present Invention.

| Entry | Sequence Description | Annotated Peptide Sequence |
|---|---|---|
| 146 | The amino acid sequence of SEQ ID 412. The conserved GCN5-related N acetyltransferase family domain is underlined and the bromodomain is in bold. | MEGHSGALGFGQGFSRSSQSPNLSPSPSHSASASVTSSG QKRKRNEVEHAGVASNSTGMFAVPPSHIYSHLHPNSMSN PNPMHNSHPSSLSESRDGALTSNDDDDNLTGGNQSQLDS MSAGNTDGREDFDDEDDDDDEEDDDEVEGDEEDQDHDP DADDDSDDGHDSMRTFTAARLDNGAPNSRNLKPKADAAG VAIAPTVKTEPILDTVKEEKVSGNNNNNSVSANNAQVAP SGSAVLLSAVKEEANKFTSTDHIQTSGAYCAREESLKRE EDADRLRFVCFGNDGIDQHMIWLIGLKNIFARQLPNNPK EYIVRLVMDRSHKS<u>VMIIKQNQVVGGITYRPYLSQKFGE IAFCAITADEQVKGYGTRLMNHLKQHARDVDGLTHFLTY ADNNAVGYFIKQDFTKEIKLEKERWHGYIKDYDGGILME CKIDPKLPYTDLPANIRWQRQTIDEKIRELSNCHIVYSG IDIQRKEAGIPRKPIKVEDIPGLKEAGWTTDOWGNSRFR LLNSPSEGLPNRQ</u>VLHAFMRSLHKAMVEHADAWPFKEPV DPRDVPDYYDIIKDPMDVKRMFTNARTYNTHETIYYKCA NR |
| 147 | The amino acid sequence of SEQ ID 413. The conserved histone deacetylase family domain is underlined. | MEESGNSLTSGPDGSK<u>RRVSYFYDSDIGNYYYSQGHPMK PHRTRMAHSLIVHYALDEKNEVCRFNLLQSRELRVFHAD DYISFLQSVTFETQHEQLRQLKRFNVGEDCFVFDGLYNF CQTYAGGSVGAAIKLNNKEADIAINWSGGLHHAKKCEAS GFCYVNDIVLAILELLKVHQRVLYIDIDIHHGDGVEEAF YSTDRVMSVSFHKFGDYFFGTGHLKDVGYGKGKYYSLNV PLNDGIDDESYKNLFRFIIQKVMEIYQFEAVVLQCGADS LSGDRLGCFNLSVKGHADCVRFLRSFNVFLVLVGGGGYT IRNVARCWCYETAVAVGVEFQDKLFYNEYYEYFGFDYTL HVAFSNMENQNSAKELAKIRNTLLEQLKRIQHVFSVFFQ ERFFDTKFFEEDEEDYEKRFKGHKWGGEYFGSESDEEQK FQNRDIDISDKFGIRRQSFFNVEAAKKIKVEEEDGDIGI VNENDGAKWFLGEAG</u> |
| 148 | The amino acid sequence of SEQ ID 414. The conserve histone deacetylase domain is underlined. | MEESGNSLTSGFDGSK<u>RRVSYFYDSDIGNYYYSQGHFMK PHRIRMAHSLIVHYALDEKNEVCRFNLLQSRELRVFHAD DYTSFLQSVTFETQHEQLRQLKRFNVGEDCFVFDGLYNF CQTYAGGSVGAAIKLNNKEADIAINWSGGLHHAKKCEAS GFCYVNDIVLAILELLKVHQRVLYIDIDIHHGDGVEEAF YSTDRVNSVSFHKFGDYFFGTGHLKDVGYGKGKYYSLNV PLNDGIDDESYKNLFRFIIQKVMEIYQFEAVVLQCGADS LSGDRLGCFNLSVKGHADCVRFLRSFNVFLVLVGGGGYT IRNVARCWCYETAVAVGVEFQDKLFYNEYYEYFGFDYTL HVAFSNMENQNSAKELAKIRNTLLEQLKRIQHVFSVFFQ ERPFDTKFFEEDEEDYEKRFKGHKWGGEYFGSESDEEQK FQNRDIDISDKFGIRRQSFFNVEAAKKIKVEEEDGDIGI VNENDGAKWFLGEAG</u> |
| 149 | The amino acid sequence of SEQ ID 416. The conserved histone deacetylase family domain is underlined. | MMETGGNSLFSGFDGVK<u>RKVAYFYDFEVGNYYYGQGHPN KPHRIRMTHALLVQYGLHKEMQILKFYFARDRDLCRFHA DDYVAFLRGITFETIQDQVKALKRFNVGDDCFVFDGLYQ YCQTYAGGSVGGAVKLNHKLCDIAINWAGGLHHAKKCEA SGFCYVNDIVLAILELLKYHKRVLYVDIDIHHGDGVEEA FYTTDRVNTVSFHKFGDYFFGTGDIRDIGCGKGKYYAVN VPLDDGIDDESFQSLFKFIIQQVMLVYNFEAIVLQCGAD SLSGDRLGCFNLSVKGHAECVRYMRSFNVFLLMVGGGGY TVRNVARCWCYETGVAVGVEIDDKNFQHEYYEYFGFDYT VHVAFSNMENKNTKQYLDKIRSKILENINSLFCAFSAQF QVQFFDTDFFELEEEDYDERTRSHKWDGASCDSDSENGD LKHRNHDVEESAFFRHNLANISYNTRIKLEGVGTGGLDM AAGTDTKKNDESFEAMDYESGEELRQDHFASTINASQFC DFALLTGVQNQLQSTDTVKFIEQSGNAFGIPPPSVATVS TGTRFSSISRTSSLNSMSSVKQGSILGFNPPQGLNASGL QFFVFTSNSFIRQGGSYSITVQAFDKQGLQNHMRGFQNN PGNS</u> |
| 150 | The amino acid sequence of SEQ ID 417. The conserved histone deacetylase family domain is underlined. | MPPKDRVAYFYDGDVGSVYFGPNHPMKPHRLCMTHHLVL <u>SYELHKKMEIYRPHKAYPVELAQFHSADYVEFLHRITPD TQHLFTKELVKYNMGEDCPVFENLFEFCQIYAGGTIDAA HRLNNQICDIAINWSGGLHHAKKCEASGFCYINDLVLGI LELLKHHARVLYVDIDVHHGDGVEEAFYFTDRVMTVSFH KYGDMFFPGTGDVKEVGEREGKYYAINVPLKDGIDDASF TRLFKTIITKVVDIYQPGAIVLQCGGSLAGDRLGCFNL SIDGHAQCVRIVKRFNLPLLVTGGGGYTKENVARCWSVE TGVLLDTELPNEIPDNDYIRYFAPDYSLKINTAGNMENL NSKTYLSAIKVQVMENLRAIQHAPSVQMHEVPPDFYIPD IDEDELNPDERMDQHTQDRQIQRDDEYYDGDNDIDHDME EAS</u> |

TABLE 11-continued

Annotated Peptide Sequences of the Present Invention.

| Entry | Sequence Description | Annotated Peptide Sequence |
|---|---|---|
| 151 | The amino acid sequence of SEQ ID 418. The conserved histone deacetylase family domain is underlined. | MDSSKSEEANILHVFWHEGMLNHDLGTGVFDTLEDPGFL EVLERHPENADRVRNMLSILRKGPIAPYTEWHTGRAAYL SELYSFHRPDYVQMLARTSTAGGKTLCHGTRLNPGSWEA ALLAAGTTLEAMRYILDGHGKLSYALVRPPGHHAQPTQA DGYCFLNNAGLAVELAVASGCKRVAVVDIDVHYGNGTAE GFYERDDVLTISLHMMHGSWGPSHPQTGFHDEVGRGKGL GFNLNVPLPNGTGDKGYEHAMHELVVPAISKFMPEMIVL VIGQDSSAFDPNGRECLTMEGYRKIGQIMRQQADQFSGG RLVVVQEGGYHITYAAYCLHATLEGVLCLPHPLLSDPIA YYPEHDIYSERVTFIKNYWQGIISTTDKRN |
| 152 | The amino acid sequence of SEQ ID 419. The conserved histone deacetylase family domain is underlined. | MEESGNALVSGPDGSKRRVTYFYDADIGNYYYGQGHPMK PHRMRMAHNLIVHYGLHQRNEVCRPHLAQSEDIRAFHTD DYIHFLSSVAPDTQQEQLRQLKRFMVGEDCPVFDGLENF CQSSAGGSIGAALKLMRKDADIAINWAGGLHHAKKCEAS GFCYVNDIVLGILELLKVHQRVLYIDIDIHHGDGVEEAF YTTDRVMTVSFHKFGDYFPGTGHIKDVGYGKGKYYALMV PLNDGIDDESYKHLFRPIIQKVMEVYQPEAVVLQCGADS LSGDRLGCFNLSVKGHADCVRFVRSFNIPLMLVGGGGYT IRNVARCWCYETAVAVGVEPQDKLPYNEYYEYFGPDYTL YVAPSNMEMLNTEKDLERMRNVLLEQLSKIQHTPSVPFQ ERPPDTEFNDEEEEDMEKRSKCRIWDGEYVGSEPEEDGK LPRFDADTYERSVLKHENKRLVPVSNVEPLKRIKQEEDG AAV |
| 153 | The amino acid sequence of SEQ ID 421. The conserved histone deacetylase family domain is underlined. | MDLNLVSHGEEEEGVRRRKVGIVYDERNCKHATPEDQPH PEQPDRIRVIWDKLNSAGVLHKCVMVEAKEASEEQLAGV HSRKHIEVMKSIGTARYNKKKRDKLAASYSSIYWSQGSS EAALLAAGSVVEISEKVASGELDAGVAIVRPPGHHAEAD KAMGFCLFNNIAIAARHLVHERPELGVQKVLIVDWDVHH GNGTQHMFWTDPHVLYFSVHRFDAGTFYPGGDDGFYDKI GEGKGAGYNINVPWEQGKCGDADYLAVWDHVLVPVAKSY DPDMVLISGGFDAALGDPLGGCRLTPYGYSLMTKKLMEF AGGKIVLALEGGYNLKSLADSFLACVEALLKDGPSRSSV LTHPFGSTWRVIQAVRKELSSFWPALMEELQLPRLLKDA SESFDKLSSSSSDESSASEDEKKFAEVTSIMEVSPDPSS ILALTAEDIAQPLAGLKIEEAGTDSQRSSDHTLLDLTND DTQKLKQFEGEIFVMIGDEESVPSASSSKDQNESTVVLS KSNIKAHSWRLTFSSIYVWYASYGSNMWNPRFLCYIEGG QVEGMAKRCCGSEDKLLLKGYSGKLFLIECFLGDHTQIH GVQEECPFLIQIVVIRVKRNSACIK |
| 154 | The amino acid sequence of SEQ ID 422. The conserved FKBP-type peptidyl-prolyl cis-trans isomerase signature is underlined and the FKBP-type peptidyl-prolyl cis-trans isomerase signatures 1 and 2 are in bold. | MADEDLDLSDVGEVEDEPGEEIESTPPLAVGQEKEINSL ALKKKLLKVGTRWETPENGDEVTVHYTGTLPDGTKFDSS RDRGEPFTFKLGQGQVIKGWDQGIVTMKKGERALFTIPP ELAYGSSGVRPTIPPNATLQFDVELLSWTNIVDVCNDGG ILKRIISEGEKYERPKDPDEVTVKYEAKLEDGTLVAKSP EEGVEFYVNDGHFCPAIAKAVKTMKRGESVILTIKPTYA FGERGKDAEEGFAAIPPNATLTTSLELVSFKAVIAVTED KKVIKKILKEADGYDKPSDGTVVQIRYTAKLQDGTIFEK KGYEGEEPFQFVVDEEQVIAGLDKAVETMKTGEIALITI GAEYGFGNFETQRDLAVIPPNSTLIYEVEMISFTKEKES WDMDTTEKIEASKQKKEQGNSLFKVGKYQRAAKKYEKAA KYIEHDSSFSAEEKRQSKVLKVSCNLNHAACRLKLKDFK EAVKLCSKVLELESQNVKALYRRAQAYIETADLDLAEFD IKKALEIEPQMREVQLEYKILKQKQIEYNKKDAKLYGNN FAKLNKLEAFEGKVLS |
| 155 | The amino acid sequence of SEQ ID 423. The conserved FKBP-type peptidyl-prolyl cis-trans isomerase family domains are underlined. The FKBP-type peptidyl-prolyl cis-trans isomerase signatures 1 and 2 are in bold. The TPR repeat is in bold/italics. | MADEGLELSDVAEVEDEPGEEFESAPPLVVGQEKELNSS GLKKRLLEAGTRCETPENGDEVTVHYTGTLLDGTKFDSS RDRGEPFTFNIGQGQVIKGWDQGIVTMKKREHALFTIPP ELAYGASGMPPTIPPNATLQFDVELLSWTNIVDVCRDGG ILKRIISDGEKYERPKDPDEVTVKYEAKLEDGMLVAKSP EEGVEFYVNDGNFCPAIVKAVKTMKKGENVTLTIKPAYA FGEQGKDAEEGFAAIPPNATITINLQLVSFKAVKEVTED KKVIKKILKEADGYDKPSDGTVVQIRYTAKLQDGTIFEK KGYAGEEPFQFVVDEEQVIAGLDKAVETMKTGEVALITI GPEYGFGNIETQRDLAVIPPYSTLIYEVEMVSFTKEKES WDMNTTENIEASKQKKEQGNSLFKVGKYLRAAKKYDKAK KYIEHDNSFSAEEKKQSKVLKVSCNLNHAACCLKLKDFK KAVKLCSEVLELESQN*VKALYRRAQAYI ETADLDLAEFD IKKALEIEPQN*REVRLEYLILKQKQIEYNKKDAKLYGNM FARQNKLEAIEGKD |

TABLE 11-continued

Annotated Peptide Sequences of the Present Invention.

| Entry | Sequence Description | Annotated Peptide Sequence |
|---|---|---|
| 156 | The amino acid sequence of SEQ ID 424. The conserved cyclophilin-type peptidyl-prolyl cis-trans isomerase signature is underlined and the cyclophilin-type peptidyl-prolyl cis-trans isomerase signature 2 is in bold. | MPNP<u>KVFFDMQVGGAPAGRIVMELYADVVPKTAENFRAL CTGEKGTGRSGKPLHFKGSSFHRVIPCFMCQGGDFTRGN GTGGESIYGEKFADENFVKKHTGPGILSMANAGPNTNGS QFFICTAQTSWLDGKHVVFGQVVEGLEVVRDIEKVGSGS GRTSKPVVIADSGQLA</u> |
| 157 | The amino acid sequence of SEQ ID 425. The conserved cyclophilin-type peptidyl-prolyl cis-trans isomerase signature is underlined andThe cyclophilin-type peptidyl-prolyl cis-trans isomerase signature 2 is in bold. | MPNP<u>KVFFDMQVGGAPAGRIVMELYADVVPKTAENFRAL CTGERGNGRSGKPLHFKGSSFHRVIPGFMCQGGDFTRGN GTGGESIYGEKFADENFVKKHTGPGILSMANAGPNTNGS QFFICTAQTSWLDGKHVVFGQVVEGLEVVRDIEKVGSGS GRTSKPVVIADSGQLA</u> |
| 158 | The amino acid sequence of SEQ ID 426. The conserved cyclophilin-type peptidyl-prolyl cis-trans isomerase signature is underlined andThe cyclophilin-type peptidyl-prolyl cis-trans isomerase signature 2 is in bold. | MPNP<u>KVFFDMQVGGAPAGRIVMELYADVVPRTAENFRAL CTGEKGTGRSGKPLHFKGSSFHRVIPGFMCQGGDFTRGN GTGGESIYGEKFADENFVKKHTGPGILSMANAGPNTNGS QFFICTAQTSWLDGKHVVFGQVVEGLEVVRDIEKVGSGS GRTSKPVVIADSGQLA</u> |
| 159 | The amino acid sequence of SEQ ID 427. The conserved cyclophilin-type peptidyl-prolyl cis-trans isomerase signature is underlined and The cyclophilin-type peptidyl-prolyl cis-trans isomerase signature 2 is in bold. | MPNP<u>KVFFDMQVGGAPAGRIVMELYADVVPKTAENFRAL CTGEKGTGRSGKPLHFKGSSFHRVIPGFMCQGGDFTRGN GTGGESIYGERFADENFVKKHTGPGILSMANAGPNTNGS QFFICTAQTSWLDGKHVVFGQVVEGLEVVRDIEKVGSGS GRTSKPVVIADSGQLA</u> |
| 160 | The amino acid sequence of SEQ ID 428. The conserved FKBP-type peptidyl-prolyl cis-trans isomerase signature is underlined and the FKBP-type peptidyl-prolyl cis-trans isomerase signature 1 is in bold and underlined. The TPR repeat is in bold/italics. | MADDFELPESAGMHENEDFGDTVFKVGEEKEIGKQGLKK LLVKEGGSWETPETGDEVEVHYTGTLLDGTKFDSSRDRG TPFKFKLGQGQVIKGWDQGIATMKKGENAVFTIPPDLAY GESGSQPTIPPNATLKFDVELLSWASVKDICKDGGIFKK IIKEGEKWEHPKEADEVLVRYEARLEDGTVVSKSEEGVE <u>FYVKDGYFCPAFAIAVKTMKKGEKVLLTVKPQYGFGHQG REAIGNDVARSTNATLLVDLELVSWKVVDEVTDDRKVLK KILKQGEGYERPNDGAVVKVKYTGKLEDGTIFEEKGSDE EPFEFMAGEEQVVDGLDRAVMTMKKGEVALVSVAAEYGY QTEIKTDLAVVPPRSTLIYEVELVSFVKEKESWDMNTAE KIEAAGKKKEEGNALFKVGKYFBASKKYEKATKYIEYDT SFSEEEKKQSKPLK</u>*VTCNLNNAACKLKL KDYTQAEKLCT KVLEVESQNVKALYRRAQA YIQTADLELAELDIKKALEI DPNN*RDVKLEYBALKEKQKEYNKKEAKFYGNMFARMSKL EELESRKSGSQKVETANREEGSDAMAVDGESA |
| 161 | The amino acid sequence of SEQ ID 429. The conserved FKBP-type peptidylprolyl isomerase domain is underlined. | MAASLTPLGAGLAYATIYDQAKVRKLEPTKRSLIALCQH SDSQHRRFITRKYHVNVQILNRRDAIRLIGLAAGLCIDL SLMYDARGAGLPPQENAKLCDTTCEKELENAPMITTESG LQYKDIKI<u>GNGPSPPIGFQVAANYVAMVPSGQVFDSSLD KGQPYIFRVGSGQVIKGLDEGLLSMKVGGRRRLYIPGPL AFPKGLNSAPGRPRVAPSSPVIFDVSLEFIPGLESEEE</u> |
| 162 | The amino acid sequence of SEQ ID 430. The conserved FKBP-type peptidylprolyl isomerase domain is underlined and the Cyclophilin-type peptidyl-prolyl cistrans isomerase signature is in bold. | MSAASLSADMAIRGTILGKTALHVLGPQVVSQCRQPVMF KCPPHTLRKMRFSAQDLQSKNFYSGFTPFKSVFISTSKR SWQAGSARAMSQDAAFQSKVTT<u>KCFLDIEIGGDPAGRIV LGLFGEDVPKTAENFRALCTGEKGFGYKGSSFHRIIKDF MLQGGDFDRGDGTGGKSIYGRTFEDENFKLAHVGPGVLS MANAGPNTNGSQFFICTVRTPWLDKRHVVFGQVIEGMEI VKKLESEETNRTDRPKRPCRIVDCGELP</u> |
| 163 | The amino acid sequence of SEQ ID 431. The conserved FKBP-type peptidylprolyl isomerase domain is underlined. | MGRIKPQTLLQQSKKKKVPGRISVSTIIVCNLIIIFLMF SLVGIYRQRAKRNRATSRSDGDEEMENFGRSKINSVP<u>HQ AIVNTTRGLITLELFGKSSAHTVEKFVEWSERGYFNGLP FYRVIKHFVIQVGDPKFAGNREDWTVGGQLNVQLEFSPK HEAFNLGTSKLEDQGDGFELFITTAPIPDLNDKLNVFGR VIKGQDVVQEIEEVDTDEHFQPKSPIIINDVRLKDEL</u> |
| 164 | The amino acid sequence of SEQ ID 432. The conserved cyclophilin-type peptidyl-prolyl cis-trans isomerase signature is underlined and the cyclophilin-type peptidyl- | MARQSTLLLFWSLVFLGAIVFTQARHEELEEVTH<u>KVYFD VDIAGKPAGRVVIGLFGKAVPKTVENFRALCTGEKGVGK SGKPLHYKGSFFHRIIPSFMIQGGDFTLGDRGGESIYG TKFADENFKLKHTGPVFITTVTTDWLDGRHVVFGRIISG MDVVYKVEAEGRQSGQPKRKVKIADSGELSMD</u> |

TABLE 11-continued

Annotated Peptide Sequences of the Present Invention.

| Entry | Sequence Description | Annotated Peptide Sequence |
|---|---|---|
| | prolyl cis-trans isomerase signature is in bold. | |
| 165 | The amino acid sequence of SEQ ID 434. The conserved FKBP-type peptidyl-prolyl cis-trans isomerase signature is underlined and the TPR repeat is in bold. | MEMDEIQEQSQPQSSERQDISQESDTGNDKTINAEKITS ENAEVEEDDMLPPKVNTEVEVLHDKVTKQIIKEGSGNKP SRNSTCFLHYRAWAESTMHKFQDTWQEQQPLELVLGREK KELSGFAIGVAGMKAGERALLHVDWQLGYGEEGNFSFPN VPPRANLIYEAELIGFEEAKEGKARSDMTVEERIEAADR RRQQGNELFKEDKLAEAMQQYEMALAYNGDDFMFQLFGK YKDMANAVKNPCHLNMAQCLLKLNRYEEAIGQCNMVLAE DEKNIKALFRRGKARATLGQTDDAREDFQKVEKFSPEDR AVIRELRLLAEHDKQVYQKQKEMFKGLFGQKPEQKPKKL HWFVVFWQWLLSNIRTIFRMRSKTD |
| 166 | The amino acid sequence of SEQ ID 435. The conserved cyclophilin-type peptidyl-prolyl cis-trans isomerase signature is underlined and the cyclophilin-type peptidyl-prolyl cis-trans isomerase signature is in bold. | MAGAGEG<u>TPEVTLETSMGPITVELYHKHAPKTCRNFLEL SRRGY</u>YNNVKFHRVIKDFMVQGG<u>DPTGTGRGGESIYGPR FEDEITRDLKHTGAGILSMANAGPNTNGSQREISLAPTP WLDEKHTIFGRVCKGMDVVKRLGNVQTDKNDRPIHDVKI LRTTVKD</u> |
| 167 | The amino acid sequence of SEQ ID 436. The conserved TPR repeat domain is underlined. | MMDPELMRLAQEQNSKISPDELMKMQRQIMANPDLMRMA SENMKNLKPEDIRFAAEQMKNVRKEEMAEISERISRASP EEIEAMKARANLQSAYQLQVAQNLKDQGNQLHARMKYSE AAEKYLQARNNLTGIPPFSEAKSLLLASSSNLMSCYLKTG QYEECVQTGSEVLAYDAMN<u>VKALYRRGQAYKQIGKLELA VADLRKAVEVSPEDETIAQALREASTELMEKGGTQDQNG PRIEEI</u>IEEEAVQPTAEKYPQSAPMVTSVTEDVSDDEQG SEDQNGFSRDSFQATNAPDGQMYAESLRNLTENPDMLRT MQSLMKNVDPDSLVALSGGKLSPDNVKTVSGNFGRMSPE EIQNMMKNSSTLSRQNPSTSSRFDDITRGHSNNDSSPQS VSVDNDLFEENQNRVGESSTNLSSSAAFSGMPNFSAENQ EQVRNQMNDPATRQMFTSMIQNMSPEMMASMSEQFGVKL SPEDAVKAQNAMASLSPNDLDRLMNWATRLQTAIDYARK IKNWILGRPGLIFAISNLLLAIILHRFGYIGD |
| 168 | The amino acid sequence of SEQ ID 437. The conserved FKBP-type peptidylprolyl isomerase domain is underlined and the Cyclophilin-type peptidyl-prolyl cis-trans isomerase signature is in bold. | MGVEKEILRP<u>GNGPKPRPGQSVTVHCTGYGKNEDLSQKF WSTKDPGQKPFTFTIGQGR</u>VIKGWDEGVLDMQLGEIPKL RCSPDYGYGSNGFPAWGIRPNSVLVFEIEVLSVN |
| 169 | The amino acid sequence of SEQ ID 438. The conserved cyclophilin-type peptidyl-prolyl cis-trans isomerase family domain is underlined and the cyclophilin-type peptidyl-prolyl cis-trans isomerase signature is in bold. | MPNP<u>RCYLDITIGEELEGRILVELYSDVVPRTAENFRAL CTGEKGIGPHTGVPLH</u>YKGLPFHRVIKGFKIQGG<u>DISAQ NGTGGESIYGLKFDDENFQLKHERRGMLSMANSGPNTNG SQFFITTTRTSHLDGKHVVFGRVIRGMGVVRGIEHTPTE SNDRPSLDVVISDCGEIPEGSDDGIANFFKDGDLYPDWP</u> ADLDEKSAEISWWMNAVDSARCFGNENYKKGDYKMALRK YRKALRYLDICWEKEEIDEEKSNHLRKTRSQIFTNSSAC KLRLGDLKGALLDTEFAMRDGEDNVKALFRQGQAYMALK DVDSAVASFRKALQLEPNDAGIRKELAVATKMINDRRDQ ERRAYARMFQ |
| 170 | The amino acid sequence of SEQ ID 439. The conserved FKBP-type peptidylprolyl isomerase domain is underlined and the Cyclophilin-type peptidyl-prolyl cis-trans isomerase signature is in bold. | MGDVIDLNGDGGVLKTIIRSAKP<u>GAMQPTEDLPNVDVHY EGTLADTGEVFDTTREDNTLFSFELGKGT</u>VIKAWDIAVK TMKVGEVAAITCKPEYAY<u>G</u>SAGSPPDIPENATLIFEVEL VACRPRKGSTFGSVSDEKARLEELKRQREIAAASREEEK KRREEARATAAARVQARLEAKKGQGRGKGKSKGK |
| 171 | The amino acid sequence of SEQ ID 440. The conserved cyclophilin-type peptidyl-prolyl cis-trans isomerase signature is underlined. | MGLGLRIASASFLPIFNIMATRSLCILLVCFIPVLAHVL SLQDPELGTV<u>RVYFQTTYGDIEFGFFPHVAPKTVEHIYK LVRLGCYNSNNFFRVDKGFVAQVADVVGGREVPLNSEQR KEGEKTIVGEFSEVKHVRGILSMGRYSDPDSASSSFSIL LGNAPHLDGQYAVFGKVTKGDDTLKRLEEVPTRQEGIFV MPLERIRILSTYYYDTNERESNLTCDHEVSILRRRLVES AYEIEYQRRKCLP</u> |
| 172 | The amino acid sequence of SEQ ID 441. The conserved FKBP-type peptidylprolyl isomerase domain is underlined and the Cyclophilan-type peptidyl-prolyl cis-trans isomerase signatures are in bold. | MASKRSLRTMNVWPTLPPLVLLLLLCFSSMSSSVVAKRS DVSELQIGVRHKP<u>KSCDIQAHKGDRI</u>VHYRGSLTDGTV FDSS<u>FERGDPIEFELGSGQ</u>VIKGWDQGLLGMCVGEKRKL RIPSKLGYGAQGSPPRIPGGATLIFDTELVAVNGRGISN DGDSDL |

TABLE 11-continued

Annotated Peptide Sequences of the Present Invention.

| Entry | Sequence Description | Annotated Peptide Sequence |
|---|---|---|
| 173 | The amino acid sequence of SEQ ID 442. The conserved FKBP-type peptidylprolyl isomerase domain is underlined and the Cyclophilin-type peptidyl-prolyl cis-trans isomerase signatures are in bold. | MSGAPAERP<u>ISYFDITIGGKPIGRIVFSLYADLVPRTAE NFRALCTGEKGIGKSGKPLCYAGSGFHRVIKGFMCQGGD FTAGNGTGGESIYGERFEDEAFPVEHTKPFLLSMANAGK DTNGSQFFITVSQTPHLDDKHVVFGEVIKGKS</u>IVRAIEN YPTASGDVPTSPIIISACGVLSPDDPSLAASEETIGDSY EDYPEDDDSDVQNPEVALDIARRIRELGNKLFKEGQIEL ALRKYLKSIRYLDVHPVLPDDSPPELKDSYDALLAPLLL NSALAALRTQPADAQTAVKNATRALERLELSDADRARAL YRBASAHVILKQEDEAEEDLVAASQLSPEDMAISSRLKE VKDEKKKRREKERKAFKKNFSS |
| 174 | The amino acid sequence of SEQ ID 443. The conserved FRBP-type peptidylprolyl isomerase domain is underlined. | MASSLRSSLFSSWALDSKSVCSLFNLNPGRMGLPSISTP LNWRTCCCSHSSELLELNEGLQSSRRKTVMGLSTVIALS LVYCDEVGAVSTSRRALRSQKVPEDEYTTLPNGLRYYDL KVGSGTEAVRGSRVAVHYVARWKGITFMTSRQGMGITGG <u>TPYGFDVGASERGAVLKGLDLGVQGMRVGGQRILIVPPE LAYGNTGIQEIPPNATLEFDVELISIKQSPFGSSVKIVE G</u> |
| 175 | The amino acid sequence of SEQ ID 444. The conserved G-protein beta WD-40 repeat domains are underlined. | MGAIEDEEPPLKRLRVSSPGLRRGLEEEAPSLSVGSVSI LMAKSLSLEEGETVGSRGLIRRVEFVRIITQALYSLGYQ RAGALLEEESGILLQSSNVALFRKQILDGRWDESVVTLR GIDQVEVEGNTLKAASFLILQQKFFELLDKGNIPEANET LRLEISPMQLNTKRVHELASCIVFPSRCEELGYSKQGNP KSSQRNKVLQEIQQLLPPSIMIPERRLERLVEQALNVQR EACIFHNSLDPALSLYTDHQCGRDQI<u>PTTTLQVLESHKN EVVWFLQFSNNGKYLASASRDCSAIIWEITEGDSFSMRHR LSAHQRPVSFVAWSPDDKLLLTCGIEEVVKLWNVETGEC KLTYDKANSGFTSCGWFPDGERFISGGVDKCIYIWDLEG</u> KELDSWRGQGMPKISDLAVTSDGREIISICGDNAIVMYN LDTKTERLIEEESGITSLCVSKDSRFLLLNLANQEIHLW DIGARSKLLLKYRGHRQGRYVIRSCFGGSDLAFVVSGSE DSQVYIWHRGN<u>GELLAVLPGHSGTVNCVSWNPVNPHVFA SASDDYTIRIWG</u>VNRNTFRSKNASSSNGVVHLANGGP |
| 176 | The amino acid sequence of SEQ ID 445. The conserved G-protein beta WD-40 repeat domains are underlined and the Trp-Asp (WD) repeats signature is in bold. | MPGTTAGAGIEPIEPQSLKKLSLKSLKRSFDLFASLHGE PQPPDQRSQRIRIACKVPAEYEVVKNLPTLPQREVGSSV SNSNVGETHSSLTTNQAQGFPTDTSGDLSKDEGKEITSI AVHLQPQTGLIDGKAGAIAGTSTAISSVGSSDRYQPSAA IMKRLPSKWPRPIWHPPWKNYRVISGHLGWVRSSFAFDPG <u>NEWFCTGSADRTIKIWEVATGKLKLTLTGHIEQIRGLAV SSRHPYLFSAGDDKQVKCWDLEYNKAIRSYHGHLSGVYC LALRPTLDILCTGGRDSVCRVWDIRTKAQIFALSGHENT VCSVFTQAIDPQVVTGSHDTTIKLWDLAAGKTMSLTLYH KKSVRAIAKHPFEHTFASASADNIKKFKLPKGEFLHNML SQQKTIVNAMAINEDNVLVSAGDNGSLWFWDWKSGHNFQ QAQTIVQPGSLDSEAGIYALQYDITGSRLVSCEADKTIK MWK</u>EDETATPESHPINFKAPKDIRRF |
| 177 | The amino acid sequence of SEQ ID 446. The conserved G-protein beta WD-40 repeat domains are underlined. | M<u>RPILMKGHERPLTFLKYNRDGDLLFSCAKDHTPTVWYG HNGERLGTYRGHNGAVWCCDVSRDSTRLITSSADQTAKL WN</u>VETGAQLFSFNFESPARAVDLAIGDKLVVITTDPFME LPSAIHIKRIEKDLSKQTAD<u>SVLTITGIKGRINRAVWGP LNSTIISGGEDSVVRIWDSETGKLLRESDKETGHQKPIT</u> SLCKSADGSHFLTGSLDKSARLWDIRTLTLIKTYVTERP VNAVAISPLLDHVVIGGGQEASHVTTTDRRAGKFEAKFF HKILEEEIGGVKGHFGPINSLAFNPDGRSFASGGEDGYV RL<u>HH</u>FDPDYFHIKM |
| 178 | The amino acid sequence of SEQ ID 447. The conserved G-protein beta WD-40 repeat domains are underlined. | M<u>RPILMKGHERPLTFLKYNRDGDLLFSCAKDHTPTVWYG HNGERLGTYRGHNGAVWCCDVSRDSTRLITSSADQTAKL WN</u>VETGNQLFSFNFESPARAVDLAIGDKLVVITTDPFME LPSAIHIKRIEKDLSKQTAD<u>SVLTITGIKGRINRAVWGP LNSTIISGGEDSVVRIWDSETGKLLRESDKETGHQKAIT</u> SLCKSADGSHFLTGSLDKSARLWDIRTLTLIKTYVTERP VNAVAISPLLDHVVIGGGQEASHVTTTDRRAGKFEAKFF HKILEEEIGGVKGHFGPINSLAFNPDGRSFASGGEDGYV RL<u>HH</u>FDPDYFHIKM |
| 179 | The amino acid sequence of SEQ ID 448. The conserved G-protein beta WD-40 repeat domains are underlined. | MAENNVGDFIPLDRQEYPSKPAPGAVDSSFWKSF<u>KKKEV SRQIAGVTCINFCPEPPHDFAVTSSTRVHIYDGKSCELK KTITKFKDVAYSGVFRSDGQIIAAGGETGVIQVFNAKSQ MVLRQLKGHGRPVRVVRYSPQDKLHLLSGGDDSMVKWWD ITTQE</u>ELLNLEGHKDYVRCGAASPSSVNLWATGSYDHTV |

TABLE 11-continued

Annotated Peptide Sequences of the Present Invention.

| Entry | Sequence Description | Annotated Peptide Sequence |
|---|---|---|
|  |  | RLWDLRNSKTVLQLKHGKPLEDVLFFPSGGLLATAGGNV VKVWDILGGGRPIHTMETHQKTVMAMCISKVPRSGQALG DAPSRLVTASLDGYNKVFDLDHFKVTHSARYPAPILSMG ISSLCRTMAVGTSSGLLFIRQRKGQIEDKIHSDSSGLQV NPVNDEKDSAVLKPNQYRYYLRGRSEKPSEGDYVVKRMA KVYFQEYDKDLRHFNHSKALVSALKAADSKGTVAVIEEL VARKRLIQTLSILNLDELELLINFLSRFILVPKYSRFLI SLTDRVLDARAVDLGKSENLKKQIADLKGIVVQELRVQQ SMQELQGIIEPLIRASAR |
| 180 | The amino acid sequence of SEQ ID 449. The conserved C-x8-C-x5-C-x3-H type zinc finger is underlined and in italics and the conserved Cys and His residues in bold, The conserved G-protein beta WD-40 repeat domains are underlined and the Trp-Asp (WD) repeats signature is in bold (non-italics). | MDVETSGKPTGNKRTYTRLPRQVCVFWQEGRCTRESCMF LHVDEPGSVKRGGATNGFAPKRSYNGSDERDTLAAGPPG GSRRNISARWGRGRGGIFISDERQKI*RNKVCNYWLAGNC QRGEECKYLHSF*VMGSDVKFLTQLSGHVKAIRGIAFPSD SGKLYSGGQDKKVIVWDCQTGQGTDIPLNDEVGCLMSEG PWIFVGLPNAVKAWNILTSTELSLVGPRGQVHALAVGNG MLFAGTHDGSILAWKFSPASNTFEPAASLVGHTQAVVSL VSGADRLYGGSMDKTIRVWDLGTFQCLQTLRDHTSVVMS LLCWDQFLLSCSLDNTVKVWVATSSGALEVTYTHNEEHG VLALCGMNDEQAKPVLLCSCNDNTVRLYDLPSFSERGRI FSRNEVRTFQIAPGGLFFTGDATGELKVWNWATQKS |
| 181 | The amino acid sequence of SEQ ID 450. The conserved G-protein beta WD-40 repeat domains are underlined. | MSVQELRERHAAATAKVNALRERIKAKRLQLLDTDVATY ASSNGRTPISFSFTDLVCCRTLQGHTGKVYSLDWTSEKN RIVSASQDGRLIVWNALTSQKTHAIKLPCAWVMTCAFSP SGQAVACGGLDSVCSIFQLNNQLDRDGHLPVSRILSGHR SYVSSCQYVPDGDTHVITGSGDRTCIQWDVTTGQRIAIF GGEFPLGHTADVMSVSISAANPKEFVSGSCDTTTRLWDT RIASRAIRTFHGHEADVNTVKFFPDGLRFGSGSDDGTCR LFDIRTGHQLQVYRQPPRENQSPTVTAIAFSFSGRLLFA GYSNGDCFVWDTILEKVVLNLGELQNTHNGRISCLGLSA DGSALCTGSWDKNLKIWAFGGHRKIV |
| 182 | The amino acid sequence of SEQ ID 451. The conserved G-protein beta WD-40 repeat domains are underlined. | MKVKIISRSTDEFTRERSNDLQRVFRNFDPNLHTQARAQ EYVRALNAAKLDKIFAKPFLAAMSGHIDGISAMAKSPRH LKSIFSGSVDGDIRLWDIAARRTVQQFPGHRGAVRGLTV STEGGRLISCGDDCTVRLWDIPVAGIGESSYGSENVQKP LATYVGKNSFRAVDYQWDSNVFATGGAQVDIWDHDRSEP TNSFAWGSDTVISVRFNPAEKDIFATTASDRSIVLYDLR MASPLNKLIMQTRNNAIAWNPREPMNFTAANEDCNCYSY DMRRMNISTCVHQDHVSAVMDIDYSPSGREFVTGSYDRT VRIFPYNAGHSREIYHTKRMQRVFCVKFSGDATYVVSGS DDANIRLWKAKASEQLGVLLPRERKRHEYLDAVKERFKH LPEIKRIERHRHLPKPIYKAALLRHTVNAAAKRKEERKR AHSAPGSVVTNPLRKKRIVAQLE |
| 183 | The amino acid sequence of SEQ ID 452. The conserved G-protein beta WD-40 repeat domains are underlined. | MDHYYQDDFDYLVDDEMVDFADDVEDDVRTRRRSDIDSD SENDFDLNNKSPDTTALQAKRGKDIQGIPWNRLNFTREK YRETRLQQYKNYENLPRPRRSRNLDKECTNFERGSSFYD FRHNTRSVKATIVHFQLRNLVWATSKHNVYLMQNYSIMH WSSLKQKGEEVLNVAGPIVPSVKHPGSSPQGLTRVQVSA MSVKDNLVVAGGFQGELICKYLDKPGVSFCTKISHDENG ITNAVEIYNDASGATRLMTANNDLAVRVFDTEKFTVLER FSFPWSVNHTSVSPDGKLVAVLGDNADCLLADCKTGKTV GTLRGHLDYSFAAAWHPDGYILATGNQDTTCRLWDVRKL SSSLAVLKGRNGAIRSIRFSSDGRFMAMAEPADFVHLYD TRQNYTESQEIDLFGEIAGISFSPDTEAFFVGVADRTYG SLLEFNRRRMNYYLDSIL |
| 184 | The amino acid sequence of SEQ ID 453. The conserved G-protein beta WD-40 repeat domains are underlined and the Trp-Asp (WD) repeats signatures are in bold. | MAEALVLRGTMEGHTDAVTAIATPIDNSDMIVSSSRDKS ILLWNLTKEPEKYGVPRRRLTGHSHFVQDVVISSDGQFA LSGSWDSELRLWDLNTGLTTRRFVGHTKDVLSVAFSIDN RQIVSASRDRTIIRWNTLGECKYTIQPDAEGHSNWISCV RFSPSATNPTIVSCSWDRTVKVWNLTNCKLRNTLVGHGG YVNTAAVSPDGSLCASGGKDGVTMLWDLAEGKRLYSLDA GDIIYALCFSPNRYWLCAATQQCVKIWDLESKSIVADLR PDFIPNKKAQIPYCTSLSWSADGSTLFSGYTDGKIRVWG IGHV |
| 185 | The amino acid sequence of SEQ ID 454. The conserved G-protein beta WD-40 repeat domains are underlined. | MAAIKSTSRSASVAFAPDAPLLAAGTMAGAIDLSFSSLA NLEIFKLDFQSDDPELPVVGECPSNERLNRLSWGSAGGS FGIIAGGLVDGTINIWNPATLINSEDNGDALIARLEQHT GPVRGLEFNTISTNLLASGAEDGELCIWDLANPTAPTHF PPLKGVGSGAQGEISFLAWNRKVQHILASTSYSGTTVVW DLRRQKPIISFPDATRRRCSVLQWNPDASTQLIVASDDD |

TABLE 11-continued

Annotated Peptide Sequences of the Present Invention.

| Entry | Sequence Description | Annotated Peptide Sequence |
|---|---|---|
| | | NSPTLRAWDLRNTISPYKEFVGHSRGVIAMSWCPSDSLF LLTCAKDNRTLCWDTGSGEIVCELPAGANWNFDVQWSPK IPGILSTSSFDGKIGIHNIEACSRNVSGEVEFGGAIVRG GPSALLKAPKWLERPAGVSFGFGGKLASFRPSTVAQAAD HRHSEVFIHNLVTEDNLVIRSTEFEAAIADGEKVSLRAL CDRRAEESQSDEEKETWNFLRVNFEDEGTARTKLLEHLG FKVQSEENGDLQETHSSKIDDIGSEIGKTLTLDDKTEED VLPQLKGGQDAAIPQDNGEDFFDNLHSPKEEVSLSHVGN DFVGEKDKDMVVNGAEIEHETEDLTEYSDWNEAIQHSLV VGDYKGAVLQCLSANRMADALIIAHLGGNSLWEKTRDEY LKKAKSSYLKVVSANVNNDLTGLVNSRPLKSWKETLANL CTYSQREEWTVLCDMLASRLIAAGNVMAATLCYICAGNI EKTVEIWSRSLKYDYDGRSFVDHLQDVNEKTVVLALATG QKRVSPSLSKLVENYAELLASQGLLTTAMEYLKLLGTEE SSNELSILRDRLYLSGTDNKVEASSFPFETRQDLTESQY NMHQTGFGAPETQENYQENVHQVLPSGSYTDNYQPTANT HYIAGYQPAPQQQPSFQNYFTPASYQPAPSPNVFYPSQV SQAEQSNFAPPVNQPPMKTFVPSTPPILRNVDQYQTPSL NPQLYQGVSSATVETHPYQTGAPASVSVGTTPGQPSVVP NFMVPGPVTAPTVTPRGFMPVTTPTQHPLGSANPPVQPQ SPQSSQVQSV |
| 186 | The amino acid sequence of SEQ ID 455. The conserved G-protein beta WD-40 repeat domains are underlined and the Trp-Asp (WD) repeats signature is in bold. | MAGAADSQLQTLSERDSTPNF<u>KNLHTREYAAHRKKVHSV AWNCTGTKLASGSVDQTARVWNIEPHGHSKTKDLELKGH ADSVDQLCWDPKHSELLATASGDRTVRLWDARSGKCSQQ VELSGENINITFKPDGTHIAVGNRDDELTIIDVRKFKPL HKRKFSYEVNEIAWNTTGELFFLTTGNGTVEVLSYPSLQ VLHTLVAHTAGCYCIAIDPIGRYFAVGSADALVSLWDLS EMLCVRTFTKLEWPVRTISFNHDGQYIASASEDLFIDIA DVQTGRTVHQISCPAAMNSVEWNPKYNLLAFAGDDRNKY MQDEGVFRVFGFETP</u> |
| 187 | The amino acid sequence of SEQ ID 456. The conserved G-protein beta WD-40 repeat domains are underlined. | MAATSPVGAG<u>SGRELANPPTDGISNLRFSNHSDHLLVSS WDRKVRLYDASANSLKGQFVHGGPVLDCCFHDDASGFSG SADNTVRRYDFSTRKEDILGRHEAPVRCVEYSYAAGQVI TGSWDKTLKCWDPRGASGQEKTLVGTYSQLERVYSMSLV GHRLVVATAGRHINVYDLRNMSQPEQRRESSLKYQTRCV RCYPNGTGFALSSVEGRVAMEFFDLSEAGQAKKYAFKCH RKSEAGRDTVYPVNAIAFHPIYGTFATGGCDGYVNVWDG NNKKRLYQYSKYPTSIAALSFSRDGRLLAVASSYTFEEG EKPHEPDAVFVRSVNEAEVKPKPKVYAAPP</u> |
| 188 | The amino acid sequence of SEQ ID 457. The conserved G-protein beta WD-40 repeat domains are underlined and the Trp-Asp (WD) repeats signature is in bold. | MASDDEEGFKNEEAPGVVDEAEVQEGLRACFPLSFGKQE KKQAPLESIHSATKRPEDPRPRRQLGPPRPPPSILAEQE DSDRFVGPPRPPQFVRDDNDDGEAEIMIGPPRPPAQYSD DHDNEETIGPPRPSYLEKGEETDQMVGPSKRGSDDETSG DSDDGDDAVDFRV<u>PLSNEIVLRGHTKVVSALAIDQTGSR VLTGSYDYSVRMYDFQGMTSQLKSFRQLEPAEGHQVRSL SWSPTSDRFLCVTGSAQAKIFDRDGLTLGEFVKGDMYLR DLKNTKGHISGLTCGEWHPKEKQTILTCSEDGSLRIWDV ND**FNTQKQVIKPKLAKPGRVPVTACAWGRDGRCIAGGVG DGSIQVWNLKPGWGSRPDLYVAKGHDDDITGLQFSADGN ILLTRSTDETLRVWDLREAITPLQVFRDLPNNYAQTNVA FSPDERLIFTGTSVERDGNSGGLLCFYDRQTLELVLRIG VSPVHSVVRCTWHPRHNQVFATVGDKKEGGAHILYDPAL SERGALVCVARAPRKKSLDDFEAKPVIHNPHALPLFRDE PSRKRQREKARMDPMKSQRPDLPVTGPGFGGRVGSTKGS LLTQYLLKEGGLIKETWMEEDPREAILKYADVAAKDPKF IAPAYAQTQPETVFAETDSEEEQK</u> |
| 189 | The amino acid sequence of SEQ ID 458. The conserved G-protein beta WD-40 repeat domains are underlined. | MKERGQSHAGQPSVDERYTQWKSLVPVLYDWLAMHMLVW PSLSCRWGPQMHQATYKNSQRLYLSEQTDGTVPNTLVIA TCEVVKPRVAAAEHISQFNEEARSPRVKKFKTIIHPGEV NRIRELPQNSKIVATHTDGPDVLIWDVDTQPNRQATLGA ADSRPDLVLTGHKDNAEFALAMSPSAPFVLSGGKDKCVL LWSIQDHISAATEPSSAKASKTPSSAHGEKVPKIP<u>SIGP RGVYKGHKDTVEDVQFCPSNAQEFCSVGDDSALILWDAR NGNEPVIKVEKAHNADLHCVDWNPNDENLILTGSADNSV RMFDRRNLTSSGVGSPVEKFEGHSAPVLCVQWCPDEASV FGSAAEDSYLNVWDYEKVGKNVGKKTPPGLFFQHAGHRD KVVDFHWNSFDPWTIVSVSDDGESTGGGGTLQIWRNSDL IYRPEDEVLAELERFRAHILSCQNR</u> |

TABLE 11-continued

Annotated Peptide Sequences of the Present Invention.

| Entry | Sequence Description | Annotated Peptide Sequence |
|---|---|---|
| 190 | The amino acid sequence of SEQ ID 459. The conserved G-protein beta WD-40 repeat domains are underlined. The Lissencephaly type-1-like homology motif is in bold and the CTLH, C-terminal to LisH motif is in italics. | MSSLSRELVFLILQFLDEEKFKESVHKLEQESGFFFNMK YFDEKAQAGEWDEVERYLSGFTKVDDNRYSMKIFFEIRK QKYLEALDRQDRAKAVDILVKDLKVFSTFNEELYKEITQ LLTLDNFRENEQLSKYGDTKSARTIMMSELKKLIEANPL FRERLIYPNLKASRLRTLINQSLNWQHQLCKNPRPNPDI RTLFTDHACGPPNGARTPTQPTASLGVLPKATTFTPIGP HGPFPSSSTATSGLASWMSMPNMVTSPQAPVAVGPSVPV PPNQATLLKRPRTPPGSSSVVDYQTADSEQLIKRLRPVS QSIDEATYPGPTLRVPWSTDDLP<u>KTLARALNEPYPVTSI DFHPSQQTFLLVGTKNGEITLWE</u>VGSREKLATRSFKIWD NANCSNHLEAAFVKDSSVSINRVLWSPDGTLIGIAFTKH LVHTYTFQGLD<u>LRQHLEIDAHVGGVNDLAFSHPNKQLCV VTCGDDKNIKVWDAVTGRKLYNFEGHDAPVYSVCPHHKE NIQFIFSTAVDGKIKAWL</u>YDHLGSRVDYDAPGHSCTTMM YSADGTRLFSCGTSKEGESFLVEWNESEGAIKRTYSGLR KKGSGVVQFDTTQNHFLAVGDEHLIKFWDMDSTNMLTSC DAEGGLLNLPRLRFNKEGSLLAVTTVNGIKILANADGQK LLRTMENRTFDLPSRAHIDAASATSSPATGRMERIERTS SANTVSGINGVDPAQSSEKLRLSDDLSEKTKIWKLTEIT DSIQCRCITLPENAAEPASKVSRLLYTNSGVGLLALGSN AVHKLWEWNRSEQNPSGEATASVHPQRWQPTSGLL<u>MTND ITDINPEEAVPCIALSKNDSYVMSASGGKVSLFNMMTFK VMTTFMPPPPASTFLAFHPQDNNIIAIGMEDSTIHIYNV RVDEVKTKLRGHQKRITGLAFSSTQNILVSSGADAQLCV WN</u>TETWEKRKSKTIQMPVGKTVSGDTRVQFHSDQLHILV VHETQLAIYDAYKLERQYQWVPQDALSAPILYATYSCNR QLIYATFSDG |
| 191 | The amino acid sequence of SEQ ID 460. The conserved G-protein beta WD-40 repeat domains are underlined. | MAKDEEEFRGEMEERLVNEEYKIWKKNTPFLYDLVITHA LEWPSLTVQWLPDREEPPGKDYSVQKNILGTHTSDNEPN YLNLAQVQLPLEDAENDARQYDDERGEIGGFGCANGKVQ VIQQINHDGEVNRARYNPQNPFIIATKTVSAEVYVFDYS KHPSKPPQDGGCH<u>PDLRLRGHNTEGYGLSWSPFKHGHLL SGSDDAQICLWDINVPAKNKVLEAQQIFKVHEGVVEDVA WHLRHEYLFGSVGDDRHLLIWDLRTSATNKPLHSVVAEQ GEVNCLAFNPFNEWVLATGSADRTVKLFDLRKISSALHT FSCHKEEVFQIGWSPKNETILASCSADRRLMVWDLSRID</u> EFQTPEDALDGPPELLFIHGGHTSKISDFSWNPCEDWVI ASVAEDNILQIWQMAENIYHDEEDDMPPEEVV |
| 192 | The amino acid sequence of SEQ ID 461. The conserved G-protein beta WD-40 repeat domains are underlined. | MSPGV<u>KQTGSQKFESGHQDVVHDVTMDYYGKRIATCSAD RTIKLFGLNASDTPSLLASLTGHEGPVWQVAWAHPKFGS MLASCSYDGRVIIWREGQQENEWSQVQVFKEHEASVNSI SWAPNELGLCLACGSSDGSITVFTCREDGSWDKTKIDQA HQVGVTAVSWAPASAPGSLVGQPSDPIQKLVSGGCDNTA KVWKFYNGSWKLDCFPPLQMHTDWVRDVAWAPNLGLPKS TIASCSQDGKVVIWTQGKEGDKWEGRILNDFKIPVWRVN WSLTGNILAVADGNNSVTLWKEAVDGDWNQVTTVQ</u> |
| 193 | The amino acid sequence of SEQ ID 462. The conserved G-protein beta WD-40 repeat domains are underlined. | MSSGV<u>KQTGSQRFESGHQDVVHDVTMDYYGKRIATCSAD RTIRLFGMNTSDTPTLLASLTGHEGPVWQVAWAHPKFGS MLASCSYDRRVIIWREGQQENEWSQVQVFKEHEASVNSI SWAPHELGLCLACGSSDGSITVFTGREDGSWDKTKIDQA HQVGVTAVSWAPASAPGSLVGQPSDPVQKLVSGGCDNTA KVWKFYNGSWKLDCFPPLQMHTDWVRDVAWAPNLGLPKS TIASCSQDGRVVIWTQGKEGDKWEGKILNDFKTPVWRIS WSLTGNILAVADGNNNVTLWKEAVDGEWNQVTTVQ</u> |
| 194 | The amino acid sequence of SEQ ID 463. The conserved G-protein beta WD-40 repeat domains are underlined. | MKKRSRPSNGHLSTAAKNSRKTAPITKD2FFDSAHNRN KSKGKGKSRGKGEEIFSSDEDDDAIGRDAPAEEEEEIAE EERETADEKRLRVAKAYLDEIRAITKANEEDNEEEAGED EETEAERRGKRDSLVAEILQQEQLEESGRVQRQLASRVV TPSKLVECRVVKRHKQSVTAVALTEDDLRGFSASKDGTI IHWDVETGASEKYEWPSQAVSVSSSNEVSKT<u>QKGKGSKK QGSKHVLSMAVSSDGRYLATGGLDRYIHLWDTRTQKHIQ AFRGHRGAVSCLAFRQGTQQLISGSFDRTIKLWSAEDRA</u> YMDTLYGHQSEILAVDCLRKERVLSVGRDHTLRLWKVP<u>E ETQLVFRGRAASLECCCFINNEDFLSGSDDGSIELWSML</u> RKKPVFMAKNAHGHAIVENLSEDTSTREEPDEEVTTRQL PNGNSIGNGMTNQMGITPSVESWVGAVTVCRGTDLAASG AGNGVVRLWAIENSSKSLRALHDIPLTGFVNSLTFARSG RFLIAGVGQEPRLGRWGRIQAARNGVTLCPIELS |

TABLE 11-continued

Annotated Peptide Sequences of the Present Invention.

| Entry | Sequence Description | Annotated Peptide Sequence |
|---|---|---|
| 195 | The amino acid sequence of SEQ ID 464. The conserved G-protein beta WD-40 repeat domains are underlined. | MAATFGTINTATSPHN<u>PNKSFEIVQPPNDSISSLSFSPK ANYLVATSWDNQVRCWEVLQTGASMPKAANSHDQPVLCS TWKDDGTAVFSAGCDKQAKMWPLLTGGQPVTVAMHDAPI KDIAWIPEMNLLATGSWDKTLKYWDTRQSNPVHTQQLPE RCFALSVRHPLMVVGTADRNLIIFNLQNPQTEFKRISSP LKYQTRCVAAFPDKQGFLVGSIEGRVGVHHVEEAQQSKN FTFKCHRDSNDIYAVNSLNFHPVHQTFATAGSDGAFNFW DKDSKQRLKAMARSNQPIPCSTFNSDGSLYAYAVSYDWS KGAENHNPATAKHHILLHVPQESEIKGKPRVTTSGRK</u> |
| 196 | The amino acid sequence of SEQ ID 465. The conserved G-protein beta WD-40 repeat domains are underlined. | MVVMDKGTHQTNEDESESEFIDEDDVIDEISIDEEDLPD ADVEGEDVQEDNKRSEPDENSSSLDDAIHTFEGHEDTLF AVACSPVDATWVASGGGDDKAFMWRIG<u>HATPFFELKGHT DSVVALSFSNDGLLLASGGLDGVVRIWDASTGNLIHVLD GPGGGIEWVRWHPKGHLVLAGSEDYSTWMWNADLGKCLS VYTGHCESVTCGDFTPDGKAICTGSADGSLRVWNPQTQE SKLTVKGYPYHTEGLTCLSISSDSTLVVSGSTDGSVHVV NIKNGKVVASLVGHSGSIECVRFSPSLTWVATGGMDKKL MIWELQSSSLRCTCQHEEGVMRLSWSLSSQHIITSSLDG IVRLWDSRSGVCERVFEGHNDSIQDMVVTVDQRFILTGS DDTTARVFEIGAF</u> |
| 197 | The amino acid sequence of SEQ ID 466. The conserved G-protein beta WD-40 repeat domains are underlined and the Trp-Asp (WD) repeats signature is in bold. | MPVFRTAFNGYAVKFSPFVETRLAVATAQNFGIIGNG<u>RQ HVLELTPNGIVEVCAFDSDGLYDCTWSEANENLVVSAS GDGSVKIWDIALPPV</u><u>ANPIRSLEEHAREVYSVDWNLVRK DCFLSASWDDTIRLWTIDRPQSMRLFKEHTYCIYAAVWN PRHADVFASASGDCTVRIWDVREPNATIIIPAHEHEILS CDWNKYNDCMLVTGSVDKLIKVWDIRTYRTPMTVLEGHT YAIRRVKFSPHQESLIASCSYDMTTCMWDYRAPEDALLA RYDHHTEFAVGIDISVLVEGLLASTGWDETVYVWQHGMD PRAC</u> |
| 198 | The amino acid sequence of SEQ ID 467. The conserved G-protein beta WD-40 repeat domains are underlined. | MDSRNRRSRLNLPPGMSPSSLHLETTAGSPGLSRVNSSP STPSPSRTTTYSDRFIPSRTGSRLNGFALIDKQPQPLPS PTRSAAEGRDDASSSSASAYSTLLRNELFGEDVVGPATP ATPEKSTGLYGGSRDSIKSPMSPSRNLFRFKNDHGGNSP GSPYSASTVGSEGLFSSNVGTPPPKPARKITRSPYKVLDA PALQDDFYLNLVDWSSNNVLAVGLGTCVYLWSACTSKVT RLCDLGVNDSVCSVGWTPQGTHLAVGTNIGEVQIWDTSR CKKVRTMGGHCTRAGALAWSSYILSSGSRDRNILHRDIR VQDDFIRKLVGHKSEVCGLKWSYDDRELASGGNDNQLLV W<u>NQQSAQPLLRFNEHTAAVKAIAWSPHQHGILASGGGTA DRCLRFWHTATDTRLNCVDTGSQVCNLVWCKNVNELVST HGYSQNQIMVWRYPS</u>MSKLATLTGHTLRVLYLAISPDGQ TIVTGAGDETLRFWSIFPSPKSQSAVHDSGLWSLGRTHI R |
| 199 | The amino acid sequence of SEQ ID 468. The conserved G-protein beta WD-40 repeat domains are underlined. | MEKK<u>KVVVPIVCHGHSRPIVDLFYSPVTPDGLFLISASK DSSTMLRNGETGDWIGTFEGHKGAVWSCCLDWRALRAAS GSADFSAKIWDALTGDELHCFVHKHIVRACAFSESTSLL LTGGHEKILRIFDLNRPDAPPKEVDNSPGSIRTVAWLHS DQTILSSNSDAGGVRLWDLRTEKIVRVLETKSPVTSAEV SQDGRYITTADGNSVKFWDANHFGMVKSYTHPCMVESAS LEPTMGNNFVAGGEDMWVRLFDFHTGEEIACNKGHHGPV HCVRFAPGGESYSSGSEDGTIRIWQTLNMNSEENESYGV HGLSGRVRVGVDDVVQKVEGFQITADGHLNDKPEKPNP</u> |
| 200 | The amino acid sequence of SEQ ID 469. The conserved G-protein beta WD-40 repeat domains are underlined. | MERYSQGTQKKSEIYTYEAPWQIYGMNWSVRKDKRFRLG IGSFLEEYNNRVEIIELDEESGEFKSDPRLAFDHPYPTT KIMFVPDKECQRPDLLATTGDYLRIWQVCEDRVEP<u>KSLL NNNKNSEFCAPLTSFDWNDADPKRIGTSSIDTTCTIWDI EKEVVDTQLIAHDKEVYDIAWGEVGVFASVSADGSVRVF DLRDKEHSTIIYESSQPETPLLRLGWNKQDPRFIATILM DSCKVVILDIRFPTLPVAELQRHQASVNTIAWAPHSPCH ICTAGDDSQALIWELSSVSQPLVEGGGLDPILAYTAAAE</u> INQLQWSSMQPDWVAIAFSUEVQILRV |
| 201 | The amino acid sequence of SEQ ID 470. The conserved G-protein beta WD-40 repeat domains are underlined. | MQSENNLDESLHLREVQELQGHTDTVWAVAWNPVTGIDG <u>APSMLASCSGDKTVRIWENTHTLNSTSPSWACKAVLEET HTRTVRSCAWSPNGKLLATASFDATTAIWENVGGEFECI ASLEGHENEVKSVSWSASGMLLATCGRDKSVWIWDVQPG NEFECVSVLQGHTQDVKMVQWHPNRDILVSASYDNSIKV WAEDGDGDDWACMQTLGNSVSGHTSTVWAVSFNSSGDRM VSCSDDLTLMVWDTSINPAERSGNAGPWKHLCTISGYHD RTIFSVHWSRSGLIASGASDDCIRLFS</u> |

TABLE 11-continued

Annotated Peptide Sequences of the Present Invention.

| Entry | Sequence Description | Annotated Peptide Sequence |
|---|---|---|
| 202 | The amino acid sequence of SEQ ID 471. The conserved G-protein beta WD-40 repeat domains are underlined and the Trp-Asp (WD) repeats signature is in bold. | MK<u>RAYKLQEFVAHASNVNCLKIGKKSSRVLVTGGEDHKV NMWAIGKPNAILSLSGHSSAVESVTFDSAEALVVAGAAS GTIKLWDLEEAKIVRTLTGHRSNCISVDFHPFGEFFASG SLDTNLKIWDIRRKGCIHTYKGHTRGVNSIRFSPDGRWV VSGGEDNIVKLWDLTAGKLMHDFKCHEGQIQCMDFHPQE FLLATGSADRTVKFWDLETFELIGSAGPETTGVRAMIFN PDGRTLLTGLHESLKVFSWEPLRCYDAVQVGWSKLADLN IHEGKLLGCSYNQSCVGVWVVDISRVGPYAAGNVSRTNG</u> HNEAKLASSGHPSVQQLDNNLKTNMARLSLSHSTESGIK EPKTTTSLTTTEGLSSTPQRAGIAFSSKNLPASSGPPSY VSTPKRNSTSRVQPTTNFQTLSRPDIVPVIVPRSNSLRP ETTSDVKKEMNNFGRVVPSTVSTKSTDVIKSGSNRDESD KIDSINQKRNTGNDKTDLNIARAEQHVSSRLDNTNTSSV VCDGNQPAARWIGAAKFRRNSPVDPVVSPHDRSPTFPWS ATDDGVTCQPDRQVTAPELSKRVVEPGRARALVASWETR EKALTADTPVLVSGRPPTSPGVDMNSRIPRGSHGTSESD LTVSDDNSAIEELMQQHNAFTSILQARLTKLQVIRRFWQ RNDLKGAIDATGKNGDHSVSADVISVLIERSEIFTLDIC TVILPLLTRLLQSETDRHLTVAMETLLVLVKTFGDVIRA TISATPTIGVDLQAEQRLERCNLCYVELENIKQILVPLI RRGGAVAKSAQELSLALQEV |
| 203 | The amino acid sequence of SEQ ID 472. The conserved G-protein beta WD-40 repeat domains are underlined and the Trp-Asp (WD) repeats signature is in bold. | MSTLEIEARDVIKIVLQFCKENSLHQTFQTLQNECQVSL NTVDSLETFVADINSGRWDVILPQVAQLKLPRKKLEDLY EQIVLEMIELRELDTARAILRQTQANGFMKQEQPERYLR LEHLLVRTYFDPREAYHESSKEKRRSQIAQALASEVTVV PPSRLMALIGQSLKWQQHQGLLPPGTQFDLFRGTAAVKA DEEEMY<u>PTTLAHTIKFGKQSHPECARFSPDGQYLVSCSV DGFIEVWDYISGKLKKDLQYQADDSFNMHDDAVLCVDFS RDSEMLASGSQDGKIKVWRIRTGQCLRRLERAHSQGVTS LSFSRDGSQLLSTSFDSTARIHGLKSGKALKEFRGHTSY VNDAIFTSDGGRVITASSDCTVKVWDVKTTDCIQTFKPP PPLKGGDVSVNSVHLFPKNSEHIVVCNKASSIYINTLQG QVVKSFSSGKREGGDFVAACISPKGEWIYCVGEDRNIYC FSQQSGKLEHLMKAHDKDIIGVTPHPHRNLLVTYSEDST MKIWKP</u> |
| 204 | The amino acid sequence of SEQ ID 473. The conserved G-protein beta WD-40 repeat domains are underlined. | <u>MDIELEDQPFDLDFHPSAPIVAVALITGRLQLFRYVDIS SEPERLWTVTAHTESCRAARFINAGSSVLTASPDCSILA TNVETGQPVARLDNAHGAAINCLTNLTESTIASGDENGI IKVWDTRQNSCCNKFKAHEDYISDMEFVPDTMQLLGTSG DGTLSVCNLRKNKVHARSEFSEDELLSVALMKNGKKVVC GSQEGVLLLYSWGYFKDCSDRFVGHPHSVDALLKLDEDT VLTGSSDGIIRVVSILPNKMIGVIGEHSSYPIERLAFSH DRNVLGSASHDQILKLWDIHYLHEDDEPETNKQEAVNDE</u> NVDMDLDVDTEKRPRGSKRKKRAEKGQTSSQKQSSQFFA DI |
| 205 | The amino acid sequence of SEQ ID 474. The conserved G-protein beta WD-40 repeat domains are underlined. | MDRIQQIPHTCVARKINLPLGMSKESLALNLPANLAPTM SPPSITYSDRFIPSRKASNFEEFALPDKTSPSPNSAGGQ SSSTNGEGRDDACAAYSALLRTELFPATPDKTEGCRRPV IGSPSGNVFRFKSQQCKSQSPFSLCPVGEDGDLSETGAV ARKTTRKIPRSPFKVLDAPALQDDFYLNLVDWSSHNILA VGLSACVYLWSASSSKVTKLCDLGLDDNVCSVAWTQRGT YLAVGTNNGGVQIWDAAHCKQVRTMEGHCTRVGTLAWNS HILSSGGRDRNILQRDIRA<u>QDDFVSKFSGHKSEVCGLKW SYDNRELASGGNDNQLFVWNQQSQQPVLKYNEHTAAVKA IAWSPHQHGLLASGGGTADRCIRFWNTATNTSLNCVDTG SQVCNLVWSKNVNELVSTHGYSQNQIIVWRYPTMSKLAT LTGHTLRVLYLAISPDGQTIVTGAGDETLRFWNVFPSSK</u> TQQNTIRDMGVWSSGRTHIR |
| 206 | The amino acid sequence of SEQ ID 475. The conserved G-protein beta WD-40 repeat domains are underlined. | MAGGQGEGEEKVDKLSMELTEDVMK<u>SMEIGAVFKDYNGK INSLDFHRTNNYLVTASDDEAIRLFDTASATWQKTSYSK KYGVDLICFTNHQTSVLYSSKNGWDESLRHLSLNDNKYL RYFKGHHDRVVSLCMSPKGECFMSGSLDRTVLLWDLRID</u> KCQGLIRVRGRPAVAYDEQGLVFAISNEGGLIKMFDARL YDKGPFDTFVVEGDKSEASGIKFSNDGKLILLSTMDSNI <u>HVLDAYQGTTVHSFSVEAVPNGGEAVPNGGTLEASFSPD GKFVISGSGNGNIHAWS</u>VNSGKEVACWTTEGVIPAVVKW APRRLMFASGSSVLSLWVPDLSKLASLTGSNSNSAY |

TABLE 11-continued

Annotated Peptide Sequences of the Present Invention.

| Entry | Sequence Description | Annotated Peptide Sequence |
|---|---|---|
| 207 | The amino acid sequence of SEQ ID 476. The conserved G-protein beta WD-40 repeat domains are underlined. | MHRVGSTGNTSNSSRPRREKRLTYVLNDANDSRHCSGIN CLVISKLSLLGGNDYLFSGSRDGTLKRWELADDSAVCSA TFESHVDWVNDAVLTGETLVSCSSDTTLKTWRPFSDGVC TRTLRQHSDYVTCLAAASKNSNIVASGGLGREVFIWDIE AAMAPVSRTSEAMDDDTSNGVLSSGNSVLSTTVRSTNAT NSASLHTSQLQGYTPIAAKGHKESVYALAMNDVGTLLVS GGTEKVVRVWDPRSGAKQMKLRGHTDNVRALILDSTGRF CLSGSSDSIIRLWDLGQQRCVHSYAVHTDSVWALASTPN FSHVYSGGRDLSLYLTDLTTRESLLLCMEKHPLLRLTLQ DDSIWVATTDSSLHRWPAEGQNPPKMFQRGGSFLAGNLS FTRARACLEGSAPVPVNTQPSFVIPGSPGIVQHEILNNR RHVLTKDAEGTVKLWEITRGAVLDDYGKVSFEEKKEELF EMVSIPAWFTMDTRLGSMSVHLDTPQCFTAEMYAVDLRV PDAPEEQKINLAQETLRGLLAHWLSRRRQRLATQASANG DFPAGQENALRNHISSRIDVHDDAETHIAGILPAFDFST TSPPSIITEGSQGGPWRKKITDLDGTEDEKDFPWWCLEC VLHGRLSPRESLKCSFYLHPYEGTTVQVLTQGKLSAPRI LRIQKVINYVLEKMVLDRPLDSSNSETTFTPGLSGNQSH AAVVGDGSLRSGARVWQQKAKPLVEILCNNQVLSPDMSL ATVRTYIWKKPDDLYLYYRLVQNR |
| 208 | The amino acid sequence of SEQ ID 477. The conserved G-protein beta WD-40 repeat domains are underlined. | MMKGKTIQMQAAHQNHDGETSVACVLWDWHAKHLITAGA DNTILIHSYPSSSSSKPITLRHHKNAVTALAINSNVRSL ASGSVDHSVKLYSYPGGEFQSNVTRFTLPIRSLAFNKSG ELLAAAGDDEGIKLISTIDNSIARVLKGHRGPVTSISFD PKNEFLASSDSDGTVIYWELSTGKPVHTLKKIAPNTTSN PTSLNQISWRPDGENLAVPGRKSEVSMYDRDTAEKLFSL KGGHSDTICSLAWSPNGKYIATAGTDRQVMVWDADRRQD IDKQRFDNPICSVAWKPSDNALAVIDVLGRFGVWESPIA SHMKSPADGAERYDNMEDEEPLMARYEEELEDSVSGSLN EIINDDDDDDEMGKIPRKILQKKPSVKVEKGKEESNAKA FKSGQDSFKLKSAMQEAFQPGATQRQSGKRNFLAYNMLG SVITFDNDGFSHIEVDFHDIGKGCRVPSMTDYFGFTMAS LSESGSVFGSPQKGEKNPSTLMYRPFSSWANNSEWSMRF PMGEEVKAVALGSGWVAAVTSLNFLRVFSEGGLQKFVLS MDGPVVTAAGYENLLVVVSHASNPLLSGDQVLSFTVYDI SQKTCPLSGRLPLSPGSHLTWLGFSEEGLLSSYDSEGNL RVFTNDYNGCWVPIFSAARERKSETESIWMVGLNSTQVF CVVCKLPDTYPQVAPKPVLSVLNLSLPLACSDLGADDLE NEYLRGSLLLSQMQKKAEDAVACGRESNMEEDSIFKNEA ALDRCLLRLIANCCKGDKLVRATELARLLSLEKSLQGAI KLVSAMKLPMLAERFNTILEEKILQENNETISCRRLTSE AQDMDTPISISVKQVSYGANLGDSPFLPNRQVEPKHSTP VFSKPDTRIEVDTSEAIAKGCDAQNGNIKSGDAEVQPAS HNDSIQKPSNPFAKASNTSANQAVQRNASLLSSIKQMKT ATENEGKRKERARSGSLPQKPAKQSKIS |
| 209 | The amino acid sequence of SEQ ID 478. The conserved G-protein beta WD-40 repeat domains are underlined. | MKQKRKGHQVDDPKYSVQTPQEDDTPNESGPASEEVESS DEEGGNSSNIEDDIIYSSSEEDPVVSSDYEEDEDAESDA EGVTAEQELEGDIDNALQNYNGTLTVLSNFHGENLKNAE GEDTSGDDDDEEEMPKRAEESDSPEDENDERPKRAEESD FSEDEDEERPKRAEESDSSEDEVPSRNTVGDVPLRWYKD EQHIGYDIKGKKIKKQPKKDQLDSFLASTDDSSDWRKVY DEYNDEEVELTKDEIKFISRLRKGTIPHADVNPYEPYVD WFDWKDKGHPLSNAPEPKRRFIPSKWEAKKVVKLVRAIR KGWITFQKAEEEKPRFYLMWGDDLKPSEKMANGLSYIPAP KPKLPGHEESYNPPPEYIPTQEEINSYQLMYEEDRPKFI PKRFDSLRNVPAYDRFLSEIFERCLDLYLCPRTRKKRIN IDPESLIPKLPKPKDLQPFPSICFLEYKGHTGAVSCISP ESSGQWLASGSKDGTVRIWEVETARCLKVWDIGRPIQHI AWNPVSQLSILAVAVDEEVLVLNTGLGSEDSQEKVAELL HVKSKPVSADDLGDNTSLTKWIKHEKFDGIKLTHLKPVH LISWHHKGDYFATVAPDGNTRAVLVHQLSKQQTQNPFKK MQGRVVHVLFHPSRAIFFVATKTHVRVYDLVKQQLVKRL VTGLHEVSSMAVHHKGDNLLVGSEEGKVCWFDNDLSTQP YKTLKNHSKDIHSVAFHDSYPLFASCSDDCKAYVFYGLV YSDLLQNPLIVPLKVLQGHQSVNGMGVLDCQFHPKQPWL FTAGADSVVKLYCN |
| 210 | The amino acid sequence of SEQ ID 479. The conserved G-protein beta WD-40 repeat domains are underlined. | MMSLKRGFEESLVPAKRQKTELSTVTYGDGPRRTSSLES PIMLLTGHHAAIYTMKFNPTGTVIASGSHEREIFLWNVH GDCKNFMVLKGHKNAVLDLHWTTDGCQIISASPDKTLRA WDVETGKQIKKMAEHSSFVNSCCPSRRGPPLVVSGSDDG TAKLWDLRHRGAIQTFPDKYQITAVGFSDAADKIYSGGI |

TABLE 11-continued

Annotated Peptide Sequences of the Present Invention.

| Entry | Sequence Description | Annotated Peptide Sequence |
|---|---|---|
| | | DNEIKVWDLRRGEVTMRLQGHTDTITGNQLSSDGSYLLT NSMDCSLRIWDMRPYAPQNRCVKILTGHQHNFEKNLLKC SWSSDGSKVTAGSADRNVYIWDTTTRRILYKLPGHTGSV NETGFHPTQPIIGSCSSDKQIYLGEIEPNVGYQAVI |
| 211 | The amino acid sequence of SEQ ID 480. The conserved G-protein beta WD-40 repeat domains are underlined. | MEFSDTYKHTGPCCFSPDARYLAIAVDYRLVIRDVVTLR VVQLYSCMDKISNIEWALOSEYILCGLYKRANVQAWS<u>LS QPEWTCKIDEGPAGIAHARWSPDSRHIITTSDFQLRLTV WS</u>LVNTACIHIQWPKHASKGVSFTQDGKFAAIATRRDCK DYVNLLSCHTWEVMGTFTVDTIDLADLEWSPNDSAIVVW DSPLEYKVLIYS<u>PDGRCLFKYQAYDSWLGVKTVAWSPCS QFLAVGSYDQTLRTLNHLTWKPFAEFVHVSTVRGPASAV VFKEVEEPWNLDVSGLHLNDDNAHDIQDGKPAEGHSRVR YKVVEFPVNVSSQKHPVDKPNPKQGIGLLAWSRDSQYLF TRNDNNPTALWIWDIC</u>RLELAALLIQKEPIRAAAWDPVY PRVALCTGSSHLYMWTPSGACCVNIPLPQPVVSDLKWNP DGTSMLLKDRESFCCTFVPMLPEFNDDETNEE |
| 212 | The amino acid sequence of SEQ ID 481. The conserved G-protein beta WD-40 repeat domains are underlined. | MAKLIETHSCVPSTERGRGILIAGDAKTNSIIYCNGRSV IMRNLDNPLEASVYGEHSYPATVARFSPNGEWVASGDTS GTVRIWGRGSDHTLKYEYKALAGRIDDLEWSADGQRIVV CGDSKGKSMVRAFMWDSGTNVGEFDGHSRRVLSCSFKPT RPFRVATCGEDFLVNFYEGPPFRFKTSHRDHSNYVNCVR FAPDGSKFITVGSDRKGVIFDGK<u>MGEKIGELSKEGGHTG SIYAASWSPDSKQVLTVSADKSAKIWEISETGNGTVKKT LTFGSQGGADDMLVGCLWLNDYLITVSLGGIVSLLSAVD PDKPPKTISGHMKSINAIALSLQSGQSEVCSSSYDGVIV RWI</u>LGVGYAGRVERKDSTQIKCLATIEGELVTCGFDNKV RRVPLLSEQHKESEPIDIGAQPKDLDVAVGCPELTFVST DAGIIIIRASKIVSTTNVGYAVTAAAISPDGTEAVVGGQ DGKLRVYSIKGDTLLEESVLERHRGPINAIRFSPDGSMF ASGDLNREAVVWDRITREVKLKNNVYHTARINCIAWSPD SSKVATGSLDTCILIYEVGKPASSRITIKGAHLGGVYGL AFSDQSTVISAGEDACVRVWSLP |
| 213 | The amino acid sequence of SEQ ID 482. The conserved G-protein beta WD-40 repeat domains are underlined and the Trp-Asp (WD) repeats signature is in bold. | MPQPSVILATAGYDHTVRFWEATS<u>GRCYRTLQYPDSQVN HLEITPDKQYLAAAGNPHIRLFEVNSNNPQPVISYDSHT NNVTAVGFQCDGKWMYSGSEDGTVRIWDLRAPGFQREYE SRAAVNTVVLHPNQTELISGDQNGNIRVWDLNANSCSCE LVPEDTAVRSLTVNWDGSLVVAANNHGTCYVWRLMRGTQ TMTNFEPLHKLQAHNSYILKCLLSPEFCEHHRYLATTSS DQTVKIWNV</u>DGFTLERTLTGHQRWVWDCVFSVDGAFLVT ASSDSTARLWDLSTGEAIRTYQGHHKATVCCALHDGTDG ASC |
| 214 | The amino acid sequence of SEQ ID 483. The conserved G-protein beta WD-40 repeat domains are underlined and the Trp-Asp (WD) repeats signature is in bold. The coatomer WD associated region is in bold/italics. | MLTKFETKSNRVKGLSFHPKRPWILASLHSGVIQLWDYR <u>MGTLIDKFDEHDGPVRGVHFHKTQPLFVSGGDDYKIKVW NYKMRQCLFTFVGHLDYIRTVHFENEYPWIVSASDDQTI RLWNWQS</u>RVCISVLTGHNHYVMSASFHPKEDLVVSASLD QTVRVWDISGLRKKTVSPADDLSRLAQMNTDLFGGGD<u>VV VKYVLEGHDRGVNWAAFHTSLPLIVSGADDRQVKLWRMN DTKAWEVDTLRGHTNNVSCVIFHARQDIIVSNSEDKSIR VWD</u>MSKRTSVQTFRREHDRFWILAAHPEMNLLAAGHDSG MIVFKLERERPAYVVYGGSLLYVK*DRYLRTYEFATQKDN PLIPIRKPGSIGPNQGPRSLSYSPTENAILICSDADGGA YELYAVPKDSHGRSDTVQEAKKGLGGSAVFVARNRFAVL DKNHNQVTIKNLKNEVTKKFDLPVTADALFYAGTGNLLC RSEDSVFLFDMQQRTVLGEIQTPNVRYVVWSNDMENVAL LSKHTIIIASKKLSSTCSLHETIRVKSGAWDDNGIFMYS TLNHIKYCLPNGDSGIIKTLDVPVYITKVSGKSLYCLDR DGKNRVIQIDITECLFKLALSKKKYDYVINMIRNSQLCG QAIIAYLQQKGFPEVALHFVRRDERTRFNLAVESGNIEIA VASAKEIDEKDHWYRLGVEALRQGNAGIVEYAYQRTKNF ERLSFLYLITGNLDKLSKMLRIAEMKNDVMGQFHNALYL GDIQERIKILEESGHLHLAYATASLHGLADIADRLAADL GGN*IPVLPPGKKSSLLMPPAPILHGGDWPLLRVTRGIFE GGLENSTSAAYEEEDEEAAADWGEDIDIENIEGENGEAT VLDDQEVKGGEDDEGGWDMEDLELPPDVAAANVGTNQKT LFVAPTLGMPVSQIWMQKSSLAGEHAAAGNFETALRLLT RQLGIKNFSPLKPLFLELYMGSHTFLPSFASVPAFSLAL QRGWSESASPNIRGPPALVYRLSVLEEKLTVAYRATTEG RFSEALRLFL |

TABLE 11-continued

Annotated Peptide Sequences of the Present Invention.

| Entry | Sequence Description | Annotated Peptide Sequence |
|---|---|---|
| 215 | The amino acid sequence of SEQ ID 484. The conservedG-protein beta WD-40 repeat domains are underlined. | MDLLQNYQDDSEDSNPELRNHPPLEDATATSAPAGVENE TSSSPDSSPLRLALPAKSCAPDVDETLMALGVPGSEKKN NHNKPIDPTQHSVTFNPSYDQLWAPLYGPAHPYAKDGIA QGMRNHKLGFVEDSAIEPFMFDEQYNTFPHRYGYAADPSA SLGSHIVGDLESLKKNDGASVYNLPKREHKRQKLEKKMI QKDENEEEEKEVGEEVDNPSTEEWLKKNRKSPWAGKKEG LQTELTEEQKKYAQEHAEKKGDRERGEKVEIVDKTTFHG KEERDYQGRSWIDPPKDAKATNDHCYIP<u>KRWVHTWSGHT KGVSAIRFFPKYGHLLLSAGMDTKVRIWDVFNSGKCMRT YMGHSKAVRDISFSNDGSRFLSAGYDRNIRLWDTETGKV ISTFSTGKIPYVVKLHPDEDKQNVLLAGMSDKKIVQWDM NSGEITQEYDQHLGAVNTITFVDNNRRFVTSSDDKSLRV WEFGIPVVIKYISEPHMHSMPSISLHPNTNWLAAQSLDN QILIYSTRERFQLNKKKRFAGHIAAGYACQVNFSPDGRF VMSGDGEGRCWFWDWKTCKVFRTLKCHDNVCIGCEWHPL EQSKVATCGWDGMIKYWD</u> |
| 216 | The amino acid sequence of SEQ ID 485. The conserved G-protein beta WD-40 repeat domains are underlined and the Trp-Asp (WD) repeats signature is in bold. | MARKGLGTDPAIGSLMSSKKRKEYKVTNRFQEGKRPLYA IAFNFIDARYHNIFATAGGTRVTIYQCLEGGAISVLQAY VDDD<u>KDESFYTLSWACDVNGSPLLVAGGHNGIIRVLDVA NEKVHKSFVGHGDSVNEIRTQALKPSLILSASIWESVRL WNVQTGICILIFAGAGGHRNEVLSVDFHPSDVYRIASCG MDNTVKIWSMKEFWTYVEKSFTWTDLPSKFPTKYVQFPV FIAAVHSNYVDCTRWLGNFILSKSVDNEVVLWEPYSKEQ STSDGVVDILQKYPVPECDIWFIKFSCDFHYNSMAVGNR EGKVYVWELQSSPPNLIARLSHAHCKNPIRQTAISHDGS TILCCCDDGSMWRWDVVQ</u> |
| 217 | The amino acid sequence of SEQ ID 486. The conserved G-protein beta WD-40 repeat domains are underlined and the Trp-Asp (WD) repeats signature is in bold. | MESGAGGSVGARVPSAKPEMLQQPPYSNGDDDNDMERGT APVPSSNPNTVSKWELDKDFLCPICMQTMKDAFLTACGH SFCYMCIMTHLNNKSNCPCCSLYLTNNOLFPNFLLNKLL KKTSACQMASTASPVENLCLSLQOGAEVSVKELDFLLTL LAEKKRKMEQEEAETNMEILLDFLQRLRQQKQAELNEVQ ADLHYIKDDILALEKRRLELSRARERYSRKLHMLLDDPM DTTLGHAAIDDGNNVRTAFVRGGQGDAISGRFQQKKAEI KAQASSQGMQKRANFCHSDSQVLPTLSGLTIARKRRVLA QFDDLQECYLQKRRRWATOLRKQCDGGLRKERDGNSISR EGYHAGLEEFQSILTTFTRYS<u>RLRVISELRHGDLFHSAN IVSSIEFDRDDELFATAGVSRRIKVFDFATVVNEPADVH CPVVEMSTRSKLSCLSWNKCIKSQIASSDYEGIVTVWDV NTRQSVNMYEEHEKRAWSVDFSRTEPTRLISGSDDGKVK VWCTRQETSVLNIDMKANICCVKYNPGSSYYVAVGSADH HIHYYDLRNPSVPLYEFNGHRKTVSYVKFISTNELASAS TDSTLRLWDV</u>RDNCLVRTFKGHTNEKNFVGLTVNSEYIA CGSETNGVFVYHKAISKPAAWHQFGSPDLDDSDDDTSHF ISAVCWRSESPTMLAANSQGTIKVLVLAP |
| 218 | The amino acid sequence of SEQ ID 487. The conserved G-protein beta WD-40 repeat domains are underlined. | MANYVDSRKNFKCVPALQQFYTGGPFRLSSDGSFLVCAC NDEVKVVDLATG<u>SVKNTLEGDSELIVALALTPDNKYLFS ASRSTQIKFWDLSSATCKRTWKAHNGPVADMACDASGGL LATAGADRSILVWDVDGGYCTHSFRGHQGVVTTVIFHPD PHCLLLFSGSDDATVRIWDLVAKKCISVLEKHFSTVTSL AISENGWNLLSAGRDKVVNIWDLRDYHCRATIPTYEPLE AVCVLPTGSRLVSVMNQSRALPENRKKSGAAPVYFLTVG ERGIVRIWYSEGALCLYEQKSSDAIISSDKDELKGGFVS AVLLPLTQGVHCVTADQRFLFYNLDESDEGKCDLKVSKR LIGYNEEIVDLKFLGDEEKFLAVATNLEQVRMYDLSSMT CVYELSGHTDIVLCLDTVVFSGHSLLASGSKDHTVRIWD TESKSCICVAAGHMGAVGAVAFSKKAKNFFVSGSSDRTI KVWSFASVLDFGGISKSIKLSSQAAVAAHDKDINSVAVA PNDSLICTGSQDRTARIWRLPDLVPVLVLRGHKRGVWCV EFSPVDQCVMTASGDKTIKIWALSDGSCLKTFEGHTASV LRASFLTRGTQFVSSGADGLLKLWTIKSNECIATFDQHE DKIWAMAVGKKTEMLATGGSDSLVNLWHDCTTTDEEEAL LKEEEAALKDQELLNALADTDYVKAIQLAFELRRPYKLL NVFTELYSKGHAQDQIQKVIRELGNEELRLLLEYVREWN TKPKFAHVAQFVLFQLFNVLPPKEIIEVQGISELLEGLI PYAQRHYSRIDRLMRSTFLLDYTLSSMSVLSPTETDLSS SNLLARTADPLHAQIDQFHPTHFPEPNLTPIQSLLDSGN TDSVEVTARRAKKKRVSGNDSEKTTVAEVKIGDMENAFD EPDVADQGSSRKHKPASSKKRKSIAVGNASIKRIASGNA VTIALQV</u> |

TABLE 11-continued

Annotated Peptide Sequences of the Present Invention.

| Entry | Sequence Description | Annotated Peptide Sequence |
|---|---|---|
| 219 | The amino acid sequence of SEQ ID 488. The conserved G-protein beta WD-40 repeat domains are underlined. | MESSCSSMNSNRHSTEKRCLRPLQKQGASMNKHSSDRFI PARGSIDLDVARFMVTQKQKDNNDIHALSPSPSPSKKAY QKEMADTLLKNAGAADNNCRILSFNGKSSTVSQGSQENV LANLSISRRARRYI<u>PQSADRTLDAPDLLDDYYLNLLDWS STNVLSTALGNTVYLWDASNSSISELLIADEEEGPVTSV SWAPDGSQIAVGLNNSVVQLWDSQSNKKLRALKGHHDRV GALSWNGPILTTGGLDGIIINHDVRTRDHIVQTYKGHTQ EVCGLKWSPSGQQLASGGNDNLLYIWDKSMASHNPSSQY FHQLDEHCAAVKALAWCPFQTNLLASGGGTSDGSIKFWN TQTGACLNTVDTHSQVCSLLWNRHERELLSSHGLRQNQL TLWKYPSMVKITELTGHTARVLHMAQSPDGYTVASAAAD ETLKFWQ</u>VFGAPDASKKTRTKDTKGAFNMFHMHIR |
| 220 | The amino acid sequence of SEQ ID 489. The conserved G-protein beta WD-40 repeat domains are underlined. | MLDEIVADEEEEFNIWKKNTPLLYDVVITHALEWPSLTV QWLPDRHQSPTKDYSLQKMIVGTHTSGDEPNYLMIAEVQ MPLQYSEDGNVGGFESTEAKVHIIQQINHEGEVNRAQYM PQNSFIIATKTVSSDVYVFDYTKHSSNAPQERVCN<u>PELI LKGHTNEGYSLSWSPLKEGQLLSGSNDAQICFWDINAAS GRKVVEAKQIFKVHEGAVEDVSWHLKHEYLFGSVGDDCH LLIWDTRTAAPNKPQHSVVAHESEVNSLAFNPFNEWLLA TGSADKTVKLFDLRKLSCSLHTFSNHTEEVFQIEWSPMN ETILASSGGDRRLMVWDLRRIGDEQTSEDAEDGPPELIF IHGGHTSKISDFSWNLHDDWLIASVAEDNILQIWQ</u>MAEN IYNDQADIL |
| 221 | The amino acid sequence of SEQ ID 490. The conserved G-protein beta WD-40 repeat domains are underlined. | MTKEDHGESRDEMGERMVNEEYKLWKKNTPFLYDLVITH ALEWPSLTVQWLPPSCKQQQDIIKDDDIDHPNTQMVILG THTSDNEPNYLILAEVQLHDGTEDEDGQGDVKRPQDKMK PGTSGGANGKVRILQQINHQKEVNRARYMPQKPTIIATK TVNADVYVFDYSKHPSKPPQEGR<u>CNPELRLQGHESEGYG LSWSPLKEGHLLSASDDAQICLWDITAATKAPKVVEANQ IFRYHDGPVEDVAWHAIHDHLFGSVGDDHHLLLWDIRND SEKPLHIVEAHQAEVNCLAFNPFNEWIVATGSADRTVAL HDIRKLDKVLHTCAHHMEEVFQIGWSPQNGAILASCGSD RRLMVWDLSRIGDEQNPEDAEEAPPELLFIHGGHTSKIS DFSWNPAEEWVIASVAEDNILQVWQ</u>MSEHIYNDDNDSPT A |
| 222 | The amino acid sequence of SEQ ID 491. The conserved G-protein beta WD-40 repeat domains are underlined. | MAMAMGDENAADPVEEFNIWKKNTPFLYDLVITHALEWP SLTVQWLPDRHQSSTADYSLQKMIVGTHTSEDEPNYLMI AEVQIPLQNSEDNIIGGFESTEAK<u>VQIIQKINHEGEVNK ARYMPQNSFVIATKTVSSDVYVFDYSKHPSKAPQERV</u>CN <u>PELILKGHSNEGYGLSWSPLKEGYLLSGSNDAQICLWDI NAAFGKKVLEANQIFKVHEGAVGDVSWHLKHEYLFGSVG DDCHLLIWDMRTAAPNKPQQSVIAHQSEVNSLAFNPFNE WLLATGSMDKTVKLFDLRKLSCSLHTFSNHTDQVFQIEW SPMNETILASSGADRRLMVWDLARIGETPEDEEDGPPEL LFVHGGHTSKISDFSWNLNDDRVIASVAEDNILQIWQ</u>MA ENIYHDDEDML |
| 223 | The amimo acid sequence of SEQ ID 492. The conserved G-protein beta WD-40 repeat domains are underlined and the Trp-Asp (WD) repeats signature is in bold. | MGLFEPFRALGYITDGVPFAVQRRGIETFVTLSVGKAWQ IYNCAKLIPVLVGPQMDKKIRALACWRDFTFAATGHDIA VFRRAHQVATWSGHKAKVTLLLSFGQHVLSVDLEGCLFI WAVAEVNQN<u>KPPIGQIQLGEKFSPSCIMHPDTYLNKVLI GSEEGTLQLWNVNTRKKLYEFKGWGSSIRCCVSSPALDV VGIGCSDGKIHVHNLRYDEEIVTFMHSTRGAVTALSFRT DGQPLLAAGGSSGVISIWNLEKKKLQSVIKDAHDSSVCS LHFFANEPVLMSSATDNSIKMWIFDTTDGEARLLKYRSG HSAPPMCIRYYGKGRHILSAGQDRAFRIFSVIQDQQSRE LSQGHVGKRAKKLKVKDEEIKLPPVIAFDAAEIRERDWC NVVTCHLDDPCAYTWRLQNFVIGEHILKPCLEDPTPVKS CSISACGNFAVLGTEGGWLERFNLQSGISRGTYIDIGEK RQCAHNGAVVGLACDATNTLLISGGYNGDIKVWDFKGRE LKFRWEIEVPLIKIVYHPGNGILATAADDMILRLFDVTA MRLVRIFVGHMDRVTDLCFSGDGKWLLSSSMDGTIRVWD I</u>ISSRQLNAMHMDSAVTALSLSPGMDMLATTHVGHNGIY LWANRMIYSKATDIEPFISGKQVVKVSMPTVSSKRESEE GDEKRTIVAESNVNKSDVSGSLIGDSYSAQLTPELVTLA LLPKAQWQSLVNLDIIKNRNKPIEPPKKPEKAPFFLPSL PTLSGERIFIPSSMNGDGDDETRNDKTVFEARGKKLGG ESLSFMQLLQSCAKIKDFTTFTNYLKGLSPSAVDMELRL LQIVDNENISETEHSVELQGIGMLLDYFVNEVSCNNNFE FVQALIRLFLKIHGETIRCQVSLQEKARKLLEIQSSTWE RLDTSFQNARCMITBLSSSQF |

TABLE 11-continued

Annotated Peptide Sequences of the Present Invention.

| Entry | Sequence Description | Annotated Peptide Sequence |
|---|---|---|
| 224 | The amino acid sequence of SEQ ID 493. The conserved G-protein beta WD-40 repeat domains are underlined and the Trp-Asp (WD) repeats signature is in bold. | MIAAVCWVPKGVAKVLPDSAEPPTQEEIQELLKCNVVAE SDDNEDSDEESEEMDTETDKNTDAVAKALAAANALGSQS SDFQRQHKVDDIANGLKELDMDHYDDEDEGIDIFGSGSL GNCYYPANDMDPYLVEQDDDDEDEIEDMTIRPSDLIILS ARNEDDVSHLEVWIYEEETEEGGSNMYVHHDIILPAFPL SLAWLDCNLKGGEKGNFVAVGTMQPEIELWLDLVLDEVE PAVVLGGAVKDEASGKTTKLKKKKKNKQAVNFKEGSHTD AVLGLAWNMEYRNVLASASADKSVKIWDIVAEKCEHTMQ PHTDKVQAVAWNPNQATVLLSGSFDRSVIMMDMRAPTHS GIRWPVPADVESLAWDPHTDHSFNVSAEDGTVRGFDIRA AASTADFDGKPMFILHAHDKAVCAISYNPAAPSLLTTGS TDKMVKLWDITNNQPSCIASTNPNVGAVFSAAFSKNSPF LLATGGSKGILHVWDTLDNSEVARRFGKFRPQN |
| 225 | The amino acid sequence of SEQ ID 494. The conserved eukaryotic protein kinase domain is underlined. | MIMDENEFCDIFSLRKRLCLLSSQEGEEEEELEAMSQLD AGEFTVTGNEEVVAIAEDDVNTGILSQDLFSSQDYCTPS QPQDSTDLDSKDKAPCPLSPVKSTIQRKRCRPELLSNPP DSIQFSFQRLERVRSEESIQSSSQQLARVRSEVSSSDDF KTPKITASGQKNYVSQSALALRARVNSPPCIKNPYLDEN EELNEKIQRSTRRSPACVTPIQSGACLSRYRADFHELEE IGRGNFSRVYKALNRLDGCCYAVKCSQSELRLDTERKVA LMEVQSLAALGPHKNIVGYHTAWFENDHLYIQMELCDHN LTTANDRGILRTDTDFLEAVYQIAQALEFIHGRGVAHLD VKPENIYVRDGTYKLGDFGRATLINGTLHVEEGDARYMS REILNDNYEHLDKVDMFSLGATFFELLMRKQYPGSGKRI DRDTEIEIPILPGFSIYFQELLQDLVSNDPGERPSAEDV LENPIFNEVRGAEEV |
| 226 | The amino acid sequence of SEQ ID 495. The conserved G-protein beta WD-40 repeat domains are underlined and the Trp-Asp (WD) repeats signature is in bold. | MLAPALEMEPVEPQSLEELSFESLERALDLFSPVHGQIA PPDPESEEMRISYELNFEYGGGSGSEDQVPEREESGAAQ NQGQQAAGASNALALPGPEGSEIPPMEESQNALTVGPSL RPQGLNDVGLHGEGTAIISASGSSDRNLSTSAIMERLPS RWPRPVWHPPWENYRVISGHLGWVRSIAFDPSNQWFCTG SADRTIEIWDLASGRLELTLTGHIEQIRGLAVSSKHTYM FSAGDDKQVECWDLEQNKVIRSYHGHLSGVYCLALHPTI DILLTGGRDSVCRVWDIRSKMQIFALSGHDNTVCSVFAR PTDPQVTGSHDTTIKFWDLRHGETMTTLTNHEESVRAM AQHPEENCFASASADNIEEFQLPRGEFLHNMLSQQETII NTMAVNEEGVMATGGDNGSLWFWDWKSGHNFQQAHTIVQ PGSLESEAGIYALSYDLTGSRLVSCEADETIEMWKEDEL ATPETHPLNFEPPEDIRRF |
| 227 | The amino acid sequence of SEQ ID 496. The conserved G-protein beta WD-40 repeat domains are underlined. | MEEAAKEQSAGSGEPELLRYGLRSAAEPKEDEKEEQLHQ PPPPPPQQQAAPAPAPAATRSSTSGSAGGRDRRPQQQH AVDEEYARWESLVPVLYDWLANHNLLWPSLSCRWGPQLE QATYENRQRLYISEQTDGSVPNTLVIANCEVVEPRVAAA EHVSQFNEEARSPFIREYETIIHPGEVNRIRELPQNPNI VATNTDSPDVLIWDVESQPNRHAVYGATASRPNLILTGH QENAEFALAMCPAEPFVLSGGEDETVVLWSIQDHITASA TDQTTNESPGSGGSIIEETGEGNEETGNGPSVGPRGIYC GHEDTVEDVAFCPSTAQEFCSVGDDSCLILWDARIGTNP VAKVEKAHNGDLHCVDWNPHDNNLILTGSADNSVNMFDR RNLTSNGVGSPVYEFEGHEAAVLCVQWSPDEPSVFGSSA EDGLLNIWDYERVDEEVDRAPNAPAGLFFQHAGHRDEIV DFHWNTADPWTMVSVSDDCDTAGGGGTLQIWRMSDLIYR PEEEVLAELENFEAHVLECSEA |
| 228 | The amino acid sequence of SEQ ID 497. The conserved G-protein beta WD-40 repeat domains are underlined. | MAKDEEEFRGEMEERLVNEEYKIWEENTPFLYDLVITHA LEWPSLTVQWLPDREEPPGEDYSVQEMILGTHTSDNEPN YLMLAQVQLPLEDAENDARQYDDERGEIGGFGCANGEVQ VIQQINHDGEVNRARYMPQNPFIIATKTVSAEVYVFDYS KHPSEPPQDGGCHPDLRLRGHNTEGYGLSWSPFEHGHLL SGSDDAQICLWDINVPAENEVLEAQQIFEVHEGVVEDVA WHLRHEYLFGSVGDDRHLLIWDLRTSATNEPLHSVVAHQ GEVNCLAFNPFNEWVLATGSADRTVELFDLREISSALHT FSCHEEEVFQIGWSPENETILASCSADRRLMVWDLSRID EFQTPEDALDGPPELLFIHGGHTSEISDFSWNPCEDWVI ASVAEDNILQIWQMAENIYHDEEDDMPPEEVV |
| 229 | The amino acid sequence of SEQ ID 498. The conserved cyclin-dependent kinase inhibitor domain is underined. | MGKYNREGEGVGEVAVMEVSQGSLGVRTRARTLAAASSQ KDHRRLGASESVTTEHQSSAPPASPCVESSMHTCYLELR SRELEEFSRCYHSAHGATSHGESERSLSLSEPSRLAVSE EARVASDESSHRVLQQQSSVAHSRNNSATFSHNAEPAEA AQREERRDDDHTSARPSEAPHEDEDGMEVEASFGENVMD |

TABLE 11-continued

Annotated Peptide Sequences of the Present Invention.

| Entry | Sequence Description | Annotated Peptide Sequence |
|---|---|---|
| | | LDSRERRTRETTPSSYTRDVETMETPGSTTRPPSNAGRR RFQTEGGHGTRNQFNVPTTNEIEEFFAGAEQQEQRRFTD RYNYDPVSDSPLPGRFEWVRLRP |
| 230 | The amino acid sequence of SEQ ID 499. The conserved serine/threonine protein kinase domain is underlined, and the serine/threonine protein kinase active-site signature is in bold. | MQNMEENVQSSWSLHGNEEICAR<u>YEILERVSSGTYLDVY RGRREEDGLIVALEEVHDYQSSWREIEALQRLCGCPNVV RLYEVILEFLTSDLYSVIESAENEGENGIPEAEVEAWMI QILQGLANCHANWVIHRDLKPSNMLISAYGILKLADFGS MSFLERAIYEVEYELPQEDILADAPGERLMDEDDSVEGV WNEGEEDSSTAVETNFDDMAETANLDLSWENEGDMVMQG FTSGVGTRWYRAPDFLYGATIYGEEIDLWSLGCILGELL ILEPLFSGTSNIDQLSRLVEVLGLQQEENWPGCSNLPDY RELCFPGDGSPVGLENHVPNCSDNMFSILERLVCYDPAA RLNAEEIVENEYFVEDPYPVLTHELRVPSPLREENNFSE DWAEWEDMEVDSDLENIDEFNVVHSSDGFCIKFS</u> |
| 231 | The amino acid sequence of SEQ ID 502. The conserved histone deacetylase family domain is underlined. | MADVPESLQQEKDEQGTDKNCCDGKFQKEIDIDDMEEEY NESSIDDEEENLSDNVATNNMGTIPQGQACMAVTVEGIE HANSVGCGRNGREGSEEVTAAEDMGHVSIENIREQGRNR KSSEQLLALYEQEGLLEDDEDDDDVDWEPFEGVTVQMKW YCTNCTMANSDDSVHCDSCGEHRNSDILRQGFLASPYLP AESPSSSDVPDERLEESKCVMTTLTPSISPMIGVCCSSL <u>QSERRTVVGFDERMLLHSEIQMETYPHPERPDRLRAIAA SLRAAGLFPGKCFSIPAREATCEELQTIHSLEHVNAVES TSCGMLSHLSPDTYANEHSSLAARLAAGLCADLAKAIMT GQAQNGFALVRPPGHHAGVKDSMGFCLHNNAAIAVSASR VVGAKKVLIVDWDVHHGNGTQEIFEADQSVLYISLHRNG EGFYPGSGAVTEVGSSKGEGYSVNIPWKCGGVGDNDYIF AFQHAVLPIAEQFEPDLTIISAGFDAAKGDPLGRCEVTP DGFAHMAQMLSCLSKGKMLVILEGGYNLRSISASATAVI KVLLGDNPKALPIDIQPSKGGLQTLLEVFEIQSKYWSSL</u> KGHDQKLRSQWEAQYGSKKRKVIRKRHMHIVGGPVWWKW GRKRVVYYHWFARVSSRKHL |
| 232 | The amino acid sequence of SEQ ID 503. The conserved cyclophilin-type peptidyl-prolyl cis-trans isomerase family domain is underlined and the cyclophilin-type peptidyl-prolyl cis-trans isomerase signature is in bold. | MASGAGAAGVVEWHQKPPNPKNP<u>VVFFDVTIGTIPAGRI KMELFADIVPRTAENFRQFCTGEYRKAGIPIGYKGCHFH RVIIQFMIQAGDFVKGDGSGCISIYGSKFEDENFIAKHT GPGLLSMANSGPNTNGCQFFLTCAKCDWLDNKHVVFGRV LGEGLLVLRKIENVQTGQHNRPRLPCVIAECGEM</u> |
| 233 | The amino acid sequence of SEQ ID 505. The conserved G-protein beta WD-40 repeat domain is underlined. | MDHYYQDDFDYLVDDEMVDFADDVEDDVRTRRRSDIDSD SENDFDSNNKSPDTTALQAKRGKDIQGIPWNRLNFTREK YRETRLQQYKNYENLPRPRRSRNLDKECTNFERGSSFYD FRHNTRSVKATIVHFQLRNLVWATSKHNVYLMQNYSIMH WSSLKQKGEEVLNVAGPIIPSVKHPGSSPQGLTRVQVSA MSVKDNLVVAGGFQGELICKYLDKPGVSFCTKISHDENG ITNAVEIYNDASGATRLMTANNDLAVRVFDTEKFTVLER FSFPWSVNHTSVSPDGKLVAVLGDNADCLLADCKT<u>GKTV GTLRGHLDYSFAAAWHPDGYILATGNQDTTCRLWDVRKL SSSLAVLKGRNGAIRSIRFSSDGRFMAMAEPADFVHLYD</u> TRQNYTKSQEIDLFGEIAGISFSPDTEAFFVGVADRTYG SLLEFNRRRMNYYLDSIL |
| 234 | The amino acid sequence of SEQ ID 506. The conserved G-protein beta WD-40 repeat domains are underlined. | MDCSGDEEEEQFFESLEEMLSPSDSGSEAADNETGCRNA DARSKYEIWKRAPSSIQERRQRFLVRMGLANPSELGNQV NSTSAESTCSTETANIPNGIERLRENSGAVLRTAGSSGR KTNCKNVINIGLREGSVRSSSSSNGTPDVGEDNGEFGGT IFSRSGGTWECMCKIKNLDSGKEFVVDELGQDGLWNKLR EVGTDRQLTMDEFERSLGLSPLVQELMRRESGVAQADCN GVHHHDAEISSSKRRSWLKALKSAAYSMRRPKEDQSNYD SERSGRRSGSFDVPWGKPQWTKVRHYPKRYKEFTALYMG QEIEAHEGSIWTMKFSLDGRYLASAGQDCVIHVREVIES MRTFGADTPDLYASSAYFSMNGLQELVPLSIEDHANKNK RGKIIGSKKSSNSDCIVLPNKVFQL<u>SEEPVCSFHGHLLD VFDLSWSPSQYLLSSSMDKTVRLWKLGHESCLKVFSHND IVTCIQFNPVDERYFISGSLDGKARIWSIPDRQVVDWSD</u> LREMVTAVCYTPDGQGGLVGSIKGSCRFYNTSGNKLQLE NQLNVRSKKKKSSGKKITGFQFAPGGDSQKVLITSADSR VRVYNGSELVCKYKGFRNTCSQISASFAPNGQHFVCASE DSRVYIWNHESPRGSGARHEKSSWSHEHFLSQGVSVAIP WSGMKLQPPVWNSPEFMLGQRENLLSLQGGKDVGCQNGL |

TABLE 11-continued

Annotated Peptide Sequences of the Present Invention.

| Entry | Sequence Description | Annotated Peptide Sequence |
|---|---|---|
| | | LSREAGEGQESETPLHYISQVSHSCGSQNMVDRDGQDDL SRYSACISDSRLSSFMAFPESPGNPDDLNSKVFFSDSSS KGSATWPEEKLPPTRKQSRSNSTSSHYDTLKTHLGNTIQ GQSGASAAVAWGLVIVTAGHGGEIRSFQNYGLPVRL |
| 235 | The amino acid sequence of SEQ ID 507. The conserved G-protein beta WD-40 repeat domain is underlined. | MPSIPAIGEFTVCEINRELLTTKDESDTQAKDAYAKILG LVFPPISFQIEEGFGSASRQQFDQDLDREDTIVTPSTSE GTNALQEGGLLLKGVSVLKNILASSFGPIFSPNDTKVLK KVELLQGISWHRHKHILAFISGSNQVTVHDFQDPEWR<u>ES SLLVSESQRGIEALEWRPNGGTTLSVACRGGICIWSASY PGSVAPVRSGVASFLGTSTRGSSVRWTLVDFLQIPGGKA VTALSWSPTGRLLASASREDSSFTIWDVAQGVGTPLRRG LGGISLLKWSPTGDYLFSAKPNGTFYLWETNTWTLEQWS SSGGCVISATWGPDGRMLFMAFSESTTLGSLHFAGRPPS LDAHLLPMELPEIGSITGGFGNIEKMAWDGCGERLAVSY TGGDLMYVGLIAIYDTRRTPFISASLVGFIRGPGEQVKP LAFAFHDKFKQGPLLSVCWSSGLCCTYPLIFRAH</u> |
| 236 | The amino acid sequence of SEQ ID 508. The conserved G-protein beta WD-40 repeat domains are underlined. | MEEENAKHTEETRQVQVRFTTKLQPALRVPTTSIAIPAN LTRYGLSDIVNTLLGNDKPQPFDFLVESELVRTSLEKLL LIKGISAEKILNIEYILAVVPPKQEEPSLHDDWVSVVDG SYPNFIFSGSFDSIGRIWKGEGLCTHVLEGHRDAITSAA FIMPSDSSDSFIN<u>LATASKDRTLRLWQ</u>FKPNEHMTNGKN VRPYKLLRGHTSSVQTVSACPRRNLICSGSWDCSIKIWQ TAGEMDIESNAGSVKKRKLEDSTEQIISQIEASRTLEGH SQCVSSVVWLEKDT<u>IYSASWDHSVRSWD</u>VETGVNSLTVG CRKALHCLSIGGEGSALIAAGGADSVLRIWDPRMPGTFT PILQLSSHKSWITACKWHPKSRHH<u>LISASHDGTLKLWDV</u> RSKVPLTTLEAHKDKVLCADWWKEDCVISGGADSTLQIF SNLNLT |
| 237 | The amino acid sequence of SEQ ID 509. The conserved RING-type zinc finger is underlined. | MNRLRSKRNHILELRLGQSEPEKEATLASNRSRGTNAPI VVEDDDDVVVSSPRSFALARSSVSQRSSRIPIVNEEDLE LRLGLAVTGRTSAEHNPRRRHGRVPPNKPIVLCDDAGEA DQSSSKKRRTGQQLSSDVQSDESKEVKLTCAICISTMEE ETSTI<u>CGHIFCKKCI</u>TNAIHRWKRCPTCRKKLAINNIHR IYISSSTG |
| 238 | The amino acid sequence of SEQ ID 510. The conserved G-protein beta WD-40 repeat domains are underlined and the splicing factor motif is in bold. | MEEPPPPAVLPSSEDTSIVSSHSFVNAPPTVPVGLDASI PQISTPGINQPGLTIPVPPEAAPLTASLVAASAGMPPAV VPSFVRPAIVAHPSVMPPPSMPLAALPMPVASAVPVAAP HFPPSTPNDNSITPSNPVPTPIVASSSVPPSVTIPGIAP LPFIAPIPVPSSRPVAPSPFMPPARPLGASVSVAMDVDN TDEQDQDADNKGESPSSSPDHPEDPSAAEYEITEESRKV RERQEQAIQELLLRRRAYALAVPTNDSSVRAPLRPLNEP ITLFGEREMERRDRLEALMAKLDAEGQLEKLMKVQEEEE AAANVDAEEVQEMEGPQVYPFYTEGSQELLKARTEITKF SLPRAVSRLQRARRKREDPDEDEDEELKCVLQQSAQINM DCSEIGDDRPLSGCAFSSDGTLLATSAWSGVTKLWSVPN <u>INKVATLKGHTERVTDVAFSPTNCHLATACADRTAMLWN SEGVLMKTYEGHLDRLARLAFHPSGLYLGTASFDKTWRL WDVNTGIELLLQEGHSRSVYGIAFQCDGSLAATCGLDGL ARIWDLRTGRSILALEGHVKPVLGIDFSPNGYHLATGSE DHTCRIWDLRKRQSVYIIPAHSHLVSQVKFEPQEGYFLV TASYDSTAKVWSARDFRSIKVLAGHEAKVTSVDITADGQ YIATVSHDRTIKLWS</u>SKNSTNDMNIG |
| 239 | The amino acid sequence of SEQ ID 511. The conserved G-protein beta WD-40 repeat domains are underlined and the Trp-Asp (WD) repeats signature is in bold. | MKRAYKLQEFVAHASNVNCLKIG<u>KKSSRVLVTGGEDHKV NMWAI</u>GK<u>PNAILSLSGHSSAVESVTFDSAEALVVAGAAS GTIKLWDLEEAKIVRTLTGHRSNCISVDFHPFGEFFASG SLDTNLKIWDIRRKGCIHTYKGHTRGVNSIRFSPDGRWV VSGGEDNIVKLWDLTAGKLMHDFKCHEGQIQCMDFHPQE FLLATGSADRTVKFWDLETFELIGSAGPETTGVRANIFN PDGRTLLTGLHESLKVFSWEPLRCYDAVDVGWSKLADLN IHEGKLLGCSYNQSCVGVWVVDISRVGPYAAGNVSRTNG HNEAKLASSGHPSVQQLDNNLKTNMARLSLSHSTESGIK EPKTTTSLTTTEGLSSTPQRAGIAFSSKNLPASSGPPSY VSTPKKNSTSRVQPTTNFQTLSRPDIVPVIVPRSNSLRP ETTSDAKKEMNNFGRVVPSTVSTKSTDVIKSGSNRDESD KIDSINQKRMTGNDRTDLNIARAEQHVSSRLDNTNTSSV VCDGNQPAARWIGAAKFRRNSPVDPVVSPHDRSPTFPWS ATDDGVTCQPDRQVTAPELSKRVVEPGRARALVASWETR EKALTADTPVLVSGRPPTSPGVDMNSFIPRGSHGTSESD LTVSDDNSAIEELNQQHNAFTSILQARLTKLQVIRRFWQ RNDLKGAIDATGKNGDNSVSADVISVLIERSEIFTLDIC |

TABLE 11-continued

Annotated Peptide Sequences of the Present Invention.

| Entry | Sequence Description | Annotated Peptide Sequence |
|---|---|---|
| | | TVILPLLTRLLQSETDRHLTVAMETLLVLVKTFGDVIRA TISATPTIGVDLQAEQRLERCNLCYVELENIKQILVPLI RRGGAVAKSAQELSLALQEV |
| 240 | The amino acid sequence of SEQ ID 512. The conserved cyclin N- and c-terminal family domains are underlined. | MAGSDENNPGVVGGAHVQEGLRVGAGKMGAGNVQQRRAL SNINSNIIGAPPYPCAVNKRVLSEKNVNSENDLLNAAHR PITRQFAAQMAYKQQLRPEENKRTTQSVSNPSKSEDCAI LDVDDDEMADDFPVPMFVQHTEAMLEEIDRMEEVEMEDV AEEPVTDIDSGDKENQLAVVEYI<u>DDLYMFYQKAEASSCV PPNYNDRQQDINERMRGILIDWLIEVHYKFELNDETLYL TVNLIDRFLAVQPVVKKKLQLVGVTAMLLACKYEEVSVP VVEDLILISDRAYSRKEVLENERLNVNTLNFNMSVPTPY VFMRRFLKAAQSDRKLELLSFFIIELSLVEYDMLKFPPS LLAASAIYTALSTITRTKQWSTTCEWHTSYSEEQLLECA RLMVTFHQRAGSGKLTGVHRKYSTSKFGHAARTEPANFL LDFRL</u> |
| 241 | The amino acid sequence of SEQ ID 513. Theconserved cyclin-dependent kinaseinhibitor domain is underlined. | MQAPREGKSAAAIVGMGKYMKKSKAIPRDVSLLEASPRS PSATGVRTRAKTLASRRLRRASQRRPPPPAAAAAAAAPS LDASPCPFSYLQLRSRRLRRFRLAPSPEARIDEGPAGSG SRGSRDASCSARTASSSGGVEGEGACVGRGDRGNGGECV RDAAVDASYGENDLEIEDRDRSTRESTPCSLIRQSNANT PPGSTTRQQSSCTAHRTQM<u>SILRSIPTSDEMEEFFAYAE QRQQRSFIEKYNFDIVKDRPLPGRFEWVQVIP</u> |
| 242 | The amino acid sequence of SEQ ID 514. The conserved GCN5-related N-acetyltransferase family domain is underlined and the bromodomain is in bold. | MDGHSSHLAAQNRSRGSQTPSPSHSAASASATSSIHLRR KLSAANASAASAAAAAAAAAAADDHAPPFPPSSISADT RDGALTSNDDLESISARGGGAGDDSDDDSDDEEEDDGDN DGGSSLRTFTAARLENVGPAAARNRKIRAESNATVKVER EDSAKDGGNGAGVGALGPAATSGAGSGSGTVPKEDAVRI FTENLQASGAYSAREENLKREEEAGRLKFECLSNDGVDD HMVWLIGLKNIFARQLPNMPKEYIVRLVNDRNHKS<u>VMVI RRNLVVGGITYRPYASQKFGEIAECAIKADEQVKGYGTR LMNHLKQHARDVDGLTHFLTYADNNAVGYFIKQGFTKEI YLDRDRWHGYIKDYDGGILMECKIDPKLPYTDLSTNVRR QRQAIDEKIRELSNCHIVYQGIDFQKRDAGVPQNTIKME DIPGLREAGWTPDQWGYSRFRGLSDQKRL</u>TFFIRQLLKV LNDHSDAWPFKEPVDAPEVPDYYDIIKDPMDLKTMTKRV ESEQYYVTLEMFIADVKRMFAHARTYNSPDTIYFKIATR LEAHFQSKVQSNLQSGAGKIQQ |
| 243 | The amino acid sequence of SEQ ID 515. The conserved TPR repeat domain is underlined | MFNGNNDPELFKLAQEQMNRNSPAELAKIQQQMNSNPEL NRMASESMKNNRPEDLRQAAEQLKHVRPEEMAEIGEKMA NASPEEIAAVRARADAQMTYEINAAKILRREGNELHSQG RFRDASQKYLRAENNLRGIPSSEGKNLLLACSLNLNSCY LKTRQYEECIKEGSEALACEEKN<u>LKAFYRRGQAYRELGQ LKDAVSDLRKAHEISPDDETIAQVLRDTEESLTKEGGSA</u> PRGVVIEEITEEDETLASVNHESPSEYSEKRHQESEDAH KGPINGDIMGQMTNSESLKALRGDPDAIRSFQNFISNAD PTTLAAMGAGNAGEVSPDLIKTASSMIGKMSAEELQRNI QLASSFPGENPYVTRNSDSNSNSFGNGSIPNVSPDNLRT ASDMNSRNSPDDLQRNFEMASSSRGKDPSLDANHASSSS GANLAANLNHILGESEPSSSYHIPSSSRNISSSPLSNFP SSPGDMQEQIRNQMRDPANRQNFTSNMKNMSPENMANMG KQFGLELSPEDAAKAQEANSSLSPEMLDRNNRWADRAQR GVETAKKTRNWLLGRPGNILAICMLLLAVILHRLGFIGS |
| 244 | The amino acid sequence of SEQ ID 516. The conserved G-protein beta WD-40 repeat domains are underlined. | MIAAISWVPRGASRAVPEVAEPPSKEEIEEILKSGVVER SGDSDGEEDDENNDAVASEKADEVSTALSAADALGRISR VTKAGSGFEDIADGLRELDNDNYDEEDEDVKLFSTGLGD LYYPSNDMDPYLKDKDDDDTEEIEDLSIKPNDSLIVGA RTDDEVNLLEVYLLEPSLSDESNNYVHHEVVISEFPLCT AWLDCPIKGGDKGNF<u>IAVGSNEPAIEIWDL</u>DIIDAVEPC LVLGGQEELRRKRKKGKRASIKYREGSHTDSVLGLAWNK EFRNI<u>LASASADRQVKIWD</u>VAAGKCNITMEHHTDKVQAV AWNHHAPQVLLSGSFDHSVVNRDGRIPSHSGYRWSVTAD VESLAWDPHSEHFFVVSLEDGTVRGFDVRAAISNSASQS LPSFTLHAHEKAVSTISYNPAAPNL<u>LATGSTDRMVKLWD LSNNQPSCIASRNPKAGAVFSVSFSEDSPLLLAIGGSKG</u> RLEVWDTSSDAAVSRRFGRHGKPRTAEPGS |
| 245 | The amino acid sequence of SEQ ID 517. The conserved Zn-finger, RING domain is underlined, and the SPX, N-terminal is in bold | MKFCKKYQEYMQGQEGKKLPGLGFKKLKKILKRCRRRDS LHSQKALQAVQNPRTCPAHCSVCDGSFFPSLLEEMSAVL GCFNKQAQKLLELHLASGFQKYLMWFKGKLRGNHVALIQ EGKDLVTYALINAIAIRKILKKYDKIHLSTQGQAFKSQV |

TABLE 11-continued

Annotated Peptide Sequences of the Present Invention.

| Entry | Sequence Description | Annotated Peptide Sequence |
|---|---|---|
| | | QRMHMEILQSPWLCELIAFHINVRETKANSGKGHALFEG CSLVVDDGKPSLSCELFDSIKLDIDLT<u>CSICLDTVFDSV SLTCGHIYCYMCACSAASVTIVDGLKAAEPKEKCPLCRE</u> ARVFEGAVHLDELNILLSRSCPEYWAERLQTERVERVRQ AKEHWESQCRAFMGVE |
| 246 | The amino acid sequence of SEQ ID 518. The conserved G-protein beta WD-40 repeat domains are underlined. | MVSTQSTRENPSIFFPPPLKPWLLPVVLSLSLSRQLGMA AAAAASLPFKKNYRSSQALQQFYAGGPFAVSSDGSFIAC NCGDSIKIVDSSNASLRPSIDCGSDTITALSLSPDGKLL FSAGHSRQIRVWDLSTSTCLRSWKGHDGPVNSMACPVSG GLLATGGADRKVMVWDVDGGFCTNFFKGHDGVVSTVLFE PDSNRS<u>LLFSGSDDGTIRVWDL</u>LAKKCASTLRGHDSTVT SLAFSEDGLTLLAAGRDRVVSLWDLHNYACKKTIPMYEV LESVCVIHSGTVLASQLGLDDQLKVTKESAQNIHFITVG ERGILRIWKSEGSVCLFKQEHSDVTVISDEDDSRSGFTA AVMLPLDQGLLCVTADQQFLFYYPEKHPEGIFSLTLCRR LVGYNEEIVDNKFLGEEENFLAVATNLEQVRVYELASMS CSYVLAGHTETVLCLDTCISSSGRTL<u>IVTGSKDNSVRLW DS</u>ESRHCIGVGVGHNGAVGAVAFSRKRQDF<u>FVSGSSDRT LKVWSL</u>DGISEDGVDSTNLKAKAVVAAHDKDINSVAVAP NDSLVCSGSQDRTACVWRLPDLVSVVVLKGHKRGIWSVE FSPVDQCVLTASGDKTVKIWAISDGSCLKTFEGHVSSVL RASFLTRGTQFVSCGADGLVKLWTVRTNECIATYDQHSD KVWALAVGKKTEMLATGGSDAVVNLWYDSTASDKEDAFR KEEEGVLKGQELENAVSDADYTKAIELALELRRPHKLFE LFSELCRTREVGDRVERILSALSGEEVCLLLEYIREWNA KPKLCHVAQSVLSQVFRILSPTEIVEIKGIGELLEGLIP YSQRHFSRIDRLVRSTYLLDYTLTGMSVIEPEADRSAVN DGSPDKSGLEKLEDGLLGENVGEEKIQNKEELESSAYKK RKLPRSKDRSKKKSKNVVYADAAAISFRA |
| 247 | The amino acid sequence of SEQ ID 519. The conserved G-protein beta WD-40 repeat domains are underlined. | MDSAPRRKSGGINLPSGNSETSLRLDGFSGSSSSFRAIS NLTSPSKSSSISDRFIPCRSSSRLHTFGLVERGSPVKEG GNEAYSRLLKAELFGSDFGSLSPAGQGSPMSPSKNMLRF KTESSGPNSPFSPSILRQDSGFSSEASTPPKPPRKVPKT PHKVLDAPSLQDDFYLNLVDWSSQNTLAVGLGTCVYLWS ASNSKVTKLCDLGPNDGVCAVQWTREGSYISIGTSLGQV QIWDGTQCKRVRTMGGHQTRTGVLAWNSRILASGSRDRV ILQHDLRV<u>PNEFIGKLVGHKSEVCGLKWSHDDRELASGG NDNQLLVWNQHSQQPVLKLTEHTAAVKAIAWSPHQNGLL ASGGGTADRCIRFWN</u>TTNGHQTSSVDTSGSQVCNLAWSKN VNELVSTHGYSQNQINVWKYP<u>SMAKVATLTGHSLRVLYL AMSPDGQTIVTGAGDETLRFWN</u>VFPSAKAPAPVKDTGLW SLGRTHIR |
| 248 | The amino acid sequence of SEQ ID 520. The conserved G-protein beta WD-40 repeat domains are underlined. | MEDEAEIYDGVRAQFPLTFGKQSKPQTSLESVHSATRRG GPAPAPAPASSSSLPSTTSPSAAGGAGKSSGLPSLSSSS TAWLEGLRAGNPPAGREAGIGSRGGDGEDGGRAMIGPPR PPPGFSANDDGGGEDDDDDGDGVNVGPPPPPPGNLGDGD DDEEEEEANIGPPRPPVVDSDEEEEEEEEENRYRLPLSN EIVLKGHNKIVSALAVDPTGSRVLSGSYDYTVRNFDFQG MNSRLSSFRDFEPVEGHQVRNLSWSPTADRFLCVTGSAQ AKIYDRDGLTLGEFVKGDMYIRDLKNTKGHITGLTWGEW HPKTKETILTSSEDGSLRIWDVNDFKSQKQVIKPKLARP GRVPVTTCTWDREGKCIAGGIGDGSIQIWNLKPGWGSRP DIHVEQAHADDITGLKFSSDGK<u>ILLTRSFDDSLKVWDLR</u> LMKNPLKVFEDLPNHYAQTNIACSPDEQLFLTGTSVERE STIGGLLCFFDRSKLELVSRIGISPTCSVVQCAWHPRLN QIFATSGDKSQGGTHVLYDPTLSERGALVCVARAPRKKS VDDFELKPVIHNPHALPLFRDQPSRKRQREKILKDPLKS HKPELPMNGPGHGGRVGASKGSLLTQYLLKQGGNIRETW MDEDPREAILKHADAAEKNPKFTRAYAETQPDPVFAKSD SEDEDK |

TABLE 12

Eucalyptus in silico Data.

| SEQ ID | ConsID eucSpp | Family | 1 | 2 | 3 | 4 | 5 | 6 | 7 | 8 | 9 | 10 | 11 | 12 |
|---|---|---|---|---|---|---|---|---|---|---|---|---|---|---|
| 1 | 3910 | Cyclin-dependant protein kinase | | 0.25 | | | | 0.11 | | 0.20 | | | | 0.73 |
| 2 | 19213 | Cyclin-dependant protein kinase | | | | | | | | 0.59 | | | | 0.64 |
| 3 | 36800 | Cyclin-dependant protein kinase | | | | | | | 0.11 | 0.36 | | | | |
| 4 | 40260 | Cyclin-dependant protein kinase | | | | 0.85 | | | | | | | | |
| 5 | 41965 | Cyclin-dependant protein kinase | | | | | 0.35 | | | | | | | 0.86 |
| 6 | 2906 | Cyclin-dependant protein kinase | | 0.93 | | | | | | | | | | 0.81 |
| 7 | 1518 | Cyclin-dependant protein kinase | | 0.08 | 0.28 | 0.08 | | 0.06 | 0.11 | | | | | |
| 8 | 8078 | Cyclin-dependant protein kinase | | | | | 0.17 | | | | | | | 3.20 |
| 9 | 9826 | Cyclin-dependant protein kinase | | | 0.36 | 0.23 | | | 0.15 | 0.04 | | 0.24 | | 0.43 |
| 10 | 10364 | Cyclin-dependant protein kinase | | | | | | | 0.11 | 1.52 | | | | 0.13 |
| 11 | 11523 | Cyclin-dependant protein kinase | | | | 0.15 | | 0.06 | 0.15 | | | | | 2.40 |
| 12 | 24358 | Cyclin-dependant protein kinase | | 0.76 | | | | | 0.07 | 0.04 | | 0.24 | | |
| 13 | 39125 | Cyclin-dependant protein kinase | | | | 0.23 | | | | | | | | |
| 14 | 5362 | Cyclin-dependant protein kinase | | 0.68 | | | | 0.06 | | 0.08 | | | | 1.17 |
| 15 | 44857 | Cyclin-dependant protein kinase | | 0.68 | | | | 0.06 | | 0.08 | | | | 1.17 |
| 16 | 1743 | Cyclin A | | | 0.19 | | 2.10 | 0.06 | 0.15 | | | | | |
| 17 | 12405 | Cyclin A | | | | | | 0.06 | 0.59 | | | 2.84 | | |
| 18 | 3739 | Cyclin B | | 0.42 | 1.99 | 0.08 | | | | | | | | 2.33 |
| 19 | 22338 | Cyclin B | | | | | | | | | | | | 0.86 |
| 20 | 28605 | Cyclin B | | | | | | 0.39 | | 0.04 | | 0.47 | | |
| 21 | 41006 | Cyclin B | | | | | | | | | | 0.71 | | |
| 22 | 6643 | Cyclin D | | 0.85 | | | 0.83 | 0.06 | 1.06 | 0.08 | | | | 0.26 |
| 23 | 45338 | Cyclin D | | | | | | | | | | | | 2.03 |
| 24 | 46486 | Cyclin D | | | | | | | | 0.30 | | | | |
| 25 | 12070 | Cyclin-dependent kinase regulatory subunit | 0.24 | 0.82 | | | | 0.06 | 0.26 | | | | | 0.92 |

TABLE 12-continued

Eucalyptus in silico Data.

| SEQ ID | ConsID eucSpp | Family | 1 | 2 | 3 | 4 | 5 | 6 | 7 | 8 | 9 | 10 | 11 | 12 |
|---|---|---|---|---|---|---|---|---|---|---|---|---|---|---|
| 26 | 6617 | Histone acetyltransferase | | 0.08 | | | | 0.06 | 0.04 | 0.55 | | | 0.51 | 0.26 |
| 27 | 7827 | Histone acetyltransferase | | | 2.27 | | | 0.11 | | 0.04 | | | | |
| 28 | 8036 | Histone acetyltransferase | | | | | 1.16 | | | | | | | |
| 30 | 1596 | Histone deacetylase | | 0.17 | 0.16 | 0.08 | 2.98 | 0.88 | 0.26 | 0.98 | | | | 0.71 |
| 31 | 5870 | Histone deacetylase | | | 0.19 | | 0.17 | | | 0.12 | | | | 5.43 |
| 32 | 6901 | Histone deacetylase | 1.21 | 0.08 | | | | 2.01 | 1.16 | 0.08 | | | | |
| 33 | 6902 | Histone deacetylase | | 0.08 | | | | 0.11 | 1.21 | | | | | 0.47 |
| 34 | 7440 | Histone deacetylase | 0.48 | | 1.23 | 0.15 | | 0.22 | 0.48 | 0.20 | | | | 2.02 |
| 35 | 8994 | Histone deacetylase | | | 0.09 | | | | 0.15 | | | | | |
| 36 | 24580 | Histone deacetylase | | 0.42 | | | | | 1.22 | | | | | |
| 37 | 37831 | Histone deacetylase | | 0.08 | | | | 0.22 | | 0.40 | | 1.19 | | 0.12 |
| 38 | 34958 | MAT1 CDK-activating kinase assembly factor | | | | | | | 0.15 | 0.23 | | | | |
| 39 | 22967 | Peptidylprolyl cis-trans isomerase | | | 0.72 | | | | | | | | | 0.69 |
| 40 | 8599 | Peptidylprolyl cis-trans isomerase | | | 0.46 | 0.08 | 0.50 | 0.17 | 0.51 | 0.28 | | | | 3.01 |
| 41 | 9919 | Peptidylprolyl cis-trans isomerase | | | 0.51 | | 0.35 | 0.06 | 0.15 | 0.43 | | | | 4.24 |
| 42 | 15820 | Peptidylprolyl cis-trans isomerase | | | | | | | 0.04 | | | | | 6.78 |
| 43 | 8327 | Peptidylprolyl cis-trans isomerase | | | | | | 0.06 | | 0.04 | | | | 6.86 |
| 44 | 4604 | Peptidylprolyl cis-trans isomerase | | | | | | | | | | | | 0.68 |
| 45 | 966 | Peptidylprolyl cis-trans isomerase | | 0.59 | 1.02 | 0.54 | 0.69 | 0.50 | 0.93 | 0.59 | | 0.95 | | 18.65 |
| 46 | 1037 | Peptidylprolyl cis-trans isomerase | | 0.59 | | | | | | | | | | |
| 47 | 4603 | Peptidylprolyl cis-trans isomerase | | 0.17 | | | | 0.17 | 1.24 | 0.04 | | | | 0.34 |
| 48 | 5465 | Peptidylprolyl cis-trans isomerase | | | 1.21 | 0.08 | 0.66 | 0.11 | 0.29 | 0.16 | | | | 6.99 |
| 49 | 6571 | Peptidylprolyl cis-trans isomerase | | | 0.51 | | 0.08 | | 0.41 | 0.08 | | | | 1.14 |

TABLE 12-continued

Eucalyptus in silico Data.

| SEQ ID | ConsID eucSpp | Family | 1 | 2 | 3 | 4 | 5 | 6 | 7 | 8 | 9 | 10 | 11 | 12 |
|---|---|---|---|---|---|---|---|---|---|---|---|---|---|---|
| 50 | 6786 | Peptidylprolyl cis-trans isomerase | | 0.42 | | | | 0.33 | 0.06 | 0.41 | 0.04 | | | |
| 51 | 7057 | Peptidylprolyl cis-trans isomerase | | 0.42 | | | | | 0.11 | 0.04 | | | | |
| 52 | 8670 | Peptidylprolyl cis-trans isomerase | | | 1.56 | | | 0.39 | | 0.20 | | | | 0.12 |
| 53 | 9137 | Peptidylprolyl cis-trans isomerase | | | | | | | 0.04 | 0.59 | | | | |
| 54 | 10285 | Peptidylprolyl cis-trans isomerase | | | | | 0.60 | 1.16 | 0.04 | 0.04 | | | | 0.45 |
| 55 | 10600 | Peptidylprolyl cis-trans isomerase | | | 0.16 | | 0.17 | 0.06 | | | | | | 0.46 |
| 56 | 11551 | Peptidylprolyl cis-trans isomerase | | | | 0.08 | | 0.06 | 0.04 | 0.08 | | | | 1.89 |
| 57 | 20743 | Peptidylprolyl cis-trans isomerase | | | | | | | | 0.76 | | | | |
| 58 | 23739 | Peptidylprolyl cis-trans isomerase | | 0.59 | | | | | | | | | | |
| 60 | 31985 | Peptidylprolyl cis-trans isomerase | | | | | 1.99 | | | | | | | |
| 61 | 32025 | Peptidylprolyl cis-trans isomerase | | | | | 0.99 | | | | | | | |
| 62 | 32173 | Peptidylprolyl cis-trans isomerase | | | | | 1.99 | | | | | | | |
| 64 | 9143 | Retinoblastoma related protein | | | 0.90 | | | | 0.15 | | | | | |
| 65 | 349 | WD40 repeat protein | 0.24 | | 0.34 | 0.08 | 0.17 | 0.22 | 0.33 | 0.08 | | | 0.25 | 2.24 |
| 66 | 575 | WD40 repeat protein | | 0.25 | 0.94 | 0.31 | 0.34 | 0.11 | | 0.16 | | 0.47 | | 1.87 |
| 67 | 804 | WD40 repeat protein | | | | 0.15 | 0.34 | 0.39 | 0.33 | 0.39 | | | | 1.82 |
| 68 | 805 | WD40 repeat protein | 0.97 | 0.51 | 4.66 | 0.23 | 0.17 | 0.77 | 0.33 | 1.07 | | 0.24 | | 4.43 |
| 69 | 806 | WD40 repeat protein | | | | | 0.83 | | | 0.04 | | | | |
| 70 | 2248 | WD40 repeat protein | | 0.08 | | 0.08 | 1.92 | 0.06 | | 0.08 | | | | 0.91 |
| 71 | 3203 | WD40 repeat protein | | 0.34 | 0.18 | 0.15 | 0.17 | 0.11 | 0.30 | 0.04 | | | | 0.72 |
| 72 | 3209 | WD40 repeat protein | | 0.08 | | 0.15 | 0.17 | | | 0.12 | | | | 0.61 |
| 73 | 4429 | WD40 repeat protein | | 0.08 | 1.16 | 0.08 | | | | | | | | 0.13 |
| 74 | 4607 | WD40 repeat protein | | 0.76 | | 0.54 | | 0.06 | 0.07 | | | | | |
| 75 | 4682 | WD40 repeat protein | | 0.08 | 0.28 | 0.23 | | | 1.13 | 0.08 | | | | 0.12 |

TABLE 12-continued

Eucalyptus in silico Data.

| SEQ ID | ConsID eucSpp | Family | 1 | 2 | 3 | 4 | 5 | 6 | 7 | 8 | 9 | 10 | 11 | 12 |
|---|---|---|---|---|---|---|---|---|---|---|---|---|---|---|
| 76 | 5786 | WD40 repeat protein | | 0.08 | | | | 0.06 | 0.46 | 0.08 | | | | 0.13 |
| 77 | 5887 | WD40 repeat protein | | 1.61 | 1.23 | 0.08 | | 0.06 | 0.15 | 0.28 | | | | 1.41 |
| 78 | 5981 | WD40 repeat protein | | 0.08 | | | | | | | | | | 0.37 |
| 79 | 6766 | WD40 repeat protein | 0.24 | 0.08 | 1.31 | | 0.51 | 0.06 | 0.74 | 0.51 | | | | 0.28 |
| 80 | 6769 | WD40 repeat protein | | 0.93 | | | 0.17 | | | 0.12 | | | | 2.28 |
| 81 | 6907 | WD40 repeat protein | | 0.25 | | | 0.17 | 0.06 | 0.45 | 0.32 | | 0.47 | | 1.67 |
| 82 | 7518 | WD40 repeat protein | | | 0.91 | | | | 0.28 | 0.15 | 0.55 | | | 0.59 |
| 83 | 7717 | WD40 repeat protein | | | 0.47 | | | | | | | | | 0.38 |
| 84 | 7718 | WD40 repeat protein | 0.24 | | 1.88 | 0.08 | | 0.22 | | 0.04 | | | | 0.92 |
| 85 | 7741 | WD40 repeat protein | | | 1.42 | | | 0.11 | | | | 0.47 | | |
| 86 | 7884 | WD40 repeat protein | | | 1.33 | 0.15 | | | | | | 0.24 | | |
| 87 | 8258 | WD40 repeat protein | 0.72 | | 0.19 | 0.23 | 0.87 | | 0.15 | 0.08 | | | | 0.08 |
| 88 | 8465 | WD40 repeat protein | | | 0.47 | 0.08 | 1.75 | | | | | | | |
| 89 | 8616 | WD40 repeat protein | | | 0.57 | 0.08 | 0.69 | | | 0.16 | | | | 0.13 |
| 90 | 8690 | WD40 repeat protein | | | 0.26 | 0.08 | 0.35 | 1.39 | 0.34 | 0.32 | | 2.13 | | 0.80 |
| 91 | 8708 | WD40 repeat protein | | | 0.57 | | | | | 0.04 | | | | |
| 92 | 8850 | WD40 repeat protein | | | 0.09 | | | 0.06 | | 0.27 | | | | 2.03 |
| 93 | 9072 | WD40 repeat protein | | | 1.21 | | 0.17 | | | | | | | 0.48 |
| 94 | 9465 | WD40 repeat protein | 0.24 | | 0.72 | | 0.33 | | 0.15 | | | | | |
| 95 | 9472 | WD40 repeat protein | | | 0.36 | | 1.99 | 0.11 | 0.61 | | | | | 6.90 |
| 96 | 9550 | WD40 repeat protein | | | 0.90 | | | 0.11 | 1.78 | | | | | |
| 97 | 10284 | WD40 repeat protein | 0.24 | 0.08 | | | 1.82 | 1.22 | 0.16 | | | 0.47 | | 0.28 |
| 98 | 10595 | WD40 repeat protein | | | 0.16 | | 0.17 | 0.11 | 6.52 | | | | | 0.85 |
| 99 | 10657 | WD40 repeat protein | | | | | | 0.06 | | 0.12 | | | | |
| 100 | 12636 | WD40 repeat protein | | | | | | 0.06 | | | | | | 0.65 |
| 101 | 12748 | WD40 repeat protein | | | 1.50 | 0.08 | | 0.06 | 1.67 | 0.04 | | | | 0.38 |
| 102 | 12879 | WD40 repeat protein | | | | 0.08 | 0.33 | 0.06 | 0.04 | 0.08 | | | | 2.00 |
| 103 | 15515 | WD40 repeat protein | | | | | 0.35 | | 0.30 | | | | | |
| 104 | 15724 | WD40 repeat protein | | 0.25 | 0.33 | 0.15 | | | 0.47 | 0.04 | | | | 0.39 |
| 105 | 16167 | WD40 repeat protein | 0.24 | | | | 0.52 | | | | | | | |
| 106 | 16633 | WD40 repeat protein | | | 1.96 | | | | | 0.12 | | | | 0.42 |
| 107 | 17485 | WD40 repeat protein | | | 0.65 | | | | | | | | | |
| 108 | 18007 | WD40 repeat protein | | | | | | | | 0.12 | | | | |
| 109 | 20775 | WD40 repeat protein | | | | | 0.17 | | | 0.08 | | | | |
| 110 | 23132 | WD40 repeat protein | | | | | | | | | | | | 2.42 |
| 111 | 23569 | WD40 repeat protein | | | | | | | 0.91 | | | | | 0.91 |
| 112 | 23611 | WD40 repeat protein | | | | | | | 4.15 | | | | | |

TABLE 12-continued

Eucalyptus in silico Data.

| SEQ ID | ConsID eucSpp | Family | 1 | 2 | 3 | 4 | 5 | 6 | 7 | 8 | 9 | 10 | 11 | 12 |
|---|---|---|---|---|---|---|---|---|---|---|---|---|---|---|
| 113 | 24934 | WD40 repeat protein | 0.34 | | | | | | | 0.04 | | | | |
| 114 | 25546 | WD40 repeat protein | | | 0.09 | | | | | | | | | |
| 115 | 30134 | WD40 repeat protein | | | | | | | 0.07 | | | | | |
| 116 | 31787 | WD40 repeat protein | | | 0.19 | | | | | | | | | 1.19 |
| 117 | 34435 | WD40 repeat protein | | | | | 0.35 | | | 0.08 | | | | |
| 118 | 34452 | WD40 repeat protein | | | 1.44 | | | | | 0.20 | | | | 0.25 |
| 119 | 35789 | WD40 repeat protein | | | | | | | | 0.20 | | | | |
| 120 | 35804 | WD40 repeat protein | | | | | | | 0.19 | 0.27 | | | | 0.08 |
| 121 | 43057 | WD40 repeat protein | | | | | | | 0.30 | | | | | 0.57 |
| 122 | 46741 | WD40 repeat protein | | | | | | | 0.46 | | | | | |
| 123 | 47161 | WD40 repeat protein | | | | | | | 1.78 | | | | | |
| 235 | 6366 | WD40 repeat protein | | 0.08 | 0.68 | 0.23 | 0.93 | 0.11 | 0.36 | 0.83 | | 0.24 | | 0.94 |
| 236 | 17378 | WD40 repeat protein | | | 0.65 | | | | | 0.12 | | | | 0.08 |
| 252 | 45414 | Cyclin B | | | | | | | | | | | | 3.13 |
| 253 | 44328 | Cyclin-dependant kinase inhibitor | | | | | | | | | | | | 0.38 |
| 254 | 15615 | Histone acetyltransferase | | | | | | | 0.22 | 0.04 | | | | |
| 255 | 17239 | Peptidylprolyl cis-trans isomerase | | | | 0.08 | 0.50 | | | 0.08 | | | | |
| 256 | 18643 | WD40 repeat protein | | | | | | | | 0.04 | | | | 0.90 |
| 257 | 19127 | WD40 repeat protein | | | | | | | | 0.04 | | | | 0.89 |
| 258 | 22624 | WD40 repeat protein | | | | | | | | | | | | 1.16 |
| 259 | 32424 | WD40 repeat protein | | | | | 0.50 | | | | | | | |
| 260 | 37472 | WD40 repeat protein | | | | | | | | 0.08 | | | | 0.17 |

In Table 12, the following numbers 1-12 represent the following tissues: 1 is bud reproductive; 2 is bud vegetative; 3 is cambium; 4 is fruit; 5 is leaf; 6 is phloem; 7 is reproductive; 8 is root; 9 is sap vegetative; 10 is stem; 11 is whole; and 12 is xylem.

TABLE 13

Pine in silico data.

| SEQ ID | ConsID pinus Radiata | Family | 1 | 2 | 3 | 4 | 5 | 6 | 7 | 8 | 9 | 10 | 11 | 12 |
|---|---|---|---|---|---|---|---|---|---|---|---|---|---|---|
| 124 | 1766 | Cyclin-dependant protein kinase | | | | 1.02 | 0.05 | 1.58 | 0.15 | 0.22 | 0.22 | 0.18 | 2.16 | 4.91 |
| 125 | 2927 | Cyclin-dependant protein kinase | 0.16 | | | | | 0.19 | 0.11 | 0.14 | 0.04 | 0.36 | 0.38 | 0.17 |
| 126 | 7642 | Cyclin-dependant protein kinase | | | 0.22 | 0.21 | 0.05 | | | | 0.07 | | | |

TABLE 13-continued

Pine in silico data.

| SEQ ID | ConsID pinus Radiata | Family | 1 | 2 | 3 | 4 | 5 | 6 | 7 | 8 | 9 | 10 | 11 | 12 |
|---|---|---|---|---|---|---|---|---|---|---|---|---|---|---|
| 127 | 13714 | Cyclin-dependant protein kinase | | | | | | 0.11 | 0.11 | | | | | |
| 128 | 16332 | Cyclin-dependant protein kinase | | | | | | 0.54 | 0.26 | | 0.14 | | 0.04 | 0.91 |
| 129 | 21677 | Cyclin-dependant protein kinase | | | | | 0.05 | 0.14 | | | | | | 0.17 |
| 130 | 27562 | Cyclin-dependant protein kinase | | | | | | | | | | | | 0.41 |
| 131 | 1504 | Cyclin-dependant protein kinase | 0.16 | | | | | 0.36 | | 0.35 | 0.21 | 0.54 | 0.09 | 0.65 |
| 132 | 15211 | Cyclin-dependant protein kinase | | | | | | 0.13 | 0.15 | | | | 0.19 | 0.19 |
| 133 | 20421 | Cyclin-dependant protein kinase | | | | | | | | | 0.04 | | 0.05 | 0.95 |
| 134 | 3187 | Cyclin-dependant protein kinase | | | | | | 0.34 | 0.15 | | 0.04 | 0.18 | 0.38 | |
| 135 | 15661 | Cyclin-dependant protein kinase | | | | | | | | | 0.04 | | 0.13 | |
| 136 | 13874 | Cyclin A | 0.31 | | | | | 0.27 | 0.15 | | | | 0.05 | |
| 137 | 14615 | Cyclin A | 0.16 | | | | | 0.15 | | | | | | |
| 138 | 4578 | Cyclin B | 0.47 | 0.14 | | | | 0.13 | 0.22 | | | | 0.74 | 0.38 |
| 139 | 23387 | Cyclin B | | | | | | 0.29 | 0.26 | | | | | 0.17 |
| 140 | 6970 | Cyclin D | | 0.14 | | | | | | 0.27 | 0.04 | | | |
| 141 | 10322 | Cyclin D | 0.16 | | | 0.19 | | 0.06 | | | 0.14 | | 1.12 | 1.36 |
| 142 | 22721 | Cyclin D | | | | | | 0.27 | | 0.36 | | | | |
| 143 | 23407 | Cyclin D | | | | | | 0.15 | 0.26 | | | | | 0.31 |
| 144 | 1945 | Cyclin-dependent kinase regulatory subunit | | 0.28 | 0.55 | 0.41 | 0.16 | 1.62 | 5.02 | 0.22 | 0.72 | | 0.39 | 3.06 |
| 145 | 8233 | Cyclin-dependent kinase regulatory subunit | | | 0.21 | | | | | | | | | |
| 146 | 8234 | Cyclin-dependent kinase regulatory subunit | 0.16 | | 0.11 | | | | | | | | | |
| 147 | 22054 | Cyclin-dependent kinase regulatory subunit | | | | | 0.05 | | 0.22 | | | | 0.18 | |
| 148 | 12137 | Histone acetyltransferase | | | | | | 0.06 | | | | | 1.51 | 0.19 |
| 149 | 12582 | Histone acetyltransferase | | | | | | 0.64 | 0.15 | 1.09 | | | 0.33 | 0.63 |
| 150 | 15285 | Histone acetyltransferase | | | | 0.21 | | | | | 0.12 | | 0.70 | 0.14 |
| 151 | 17229 | Histone acetyltransferase | | | | | | | | | | | 0.94 | 0.16 |

TABLE 13-continued

Pine in silico data.

| SEQ ID | ConsID pinus Radiata | Family | 1 | 2 | 3 | 4 | 5 | 6 | 7 | 8 | 9 | 10 | 11 | 12 |
|---|---|---|---|---|---|---|---|---|---|---|---|---|---|---|
| 152 | 20724 | Histone acetyltransferase | | | | | | | | | 0.04 | | 0.19 | 0.19 |
| 153 | 4555 | Histone deacetylase | 0.16 | 0.14 | | | | 0.97 | | 0.14 | | | 0.89 | 0.89 |
| 154 | 4556 | Histone deacetylase | | | | | | | | | | | | 0.14 |
| 155 | 5729 | Histone deacetylase | 0.31 | 0.28 | 0.22 | 0.58 | 0.22 | 2.00 | 0.48 | 0.07 | 0.04 | | 2.73 | 1.46 |
| 156 | 7395 | Histone deacetylase | | 0.14 | | 0.14 | | | 0.19 | 0.93 | 0.04 | | 0.14 | 1.33 |
| 157 | 9503 | Histone deacetylase | | | 0.11 | | | | | 0.14 | | | | |
| 158 | 11283 | Histone deacetylase | | | | 0.19 | | 0.15 | | | | | 0.96 | 1.35 |
| 159 | 12322 | Histone deacetylase | 0.16 | | | | | 0.06 | 0.11 | | 0.04 | | 0.05 | 0.29 |
| 161 | 23236 | Histone deacetylase | | | | | | 0.13 | | | 0.11 | | | |
| 162 | 171 | Peptidylprolyl cis-trans isomerase | | | | | | | | | 0.07 | | | 0.46 |
| 163 | 172 | Peptidylprolyl cis-trans isomerase | | | | | | 0.19 | | | 0.11 | 0.18 | 0.11 | 0.46 |
| 164 | 1480 | Peptidylprolyl cis-trans isomerase | 2.51 | 4.20 | 0.88 | 2.97 | 1.58 | 3.53 | 7.36 | 1.33 | 2.74 | 0.72 | 6.62 | 10.14 |
| 168 | 1692 | Peptidylprolyl cis-trans isomerase | 0.16 | | 0.22 | | 0.65 | 0.61 | 0.26 | | 0.29 | 0.18 | 1.28 | 0.34 |
| 169 | 5313 | Peptidylprolyl cis-trans isomerase | | 0.14 | | | | | | 0.07 | | | 0.37 | 0.17 |
| 170 | 6362 | Peptidylprolyl cis-trans isomerase | | 0.14 | 0.33 | 0.05 | | 0.06 | 0.60 | | 0.04 | | 2.92 | 0.68 |
| 171 | 6493 | Peptidylprolyl cis-trans isomerase | | 0.42 | 0.11 | 0.21 | | | 0.11 | | 0.04 | | 0.25 | 0.32 |
| 172 | 6983 | Peptidylprolyl cis-trans isomerase | | | | 0.61 | | 0.13 | | | | | 0.04 | |
| 174 | 7665 | Peptidylprolyl cis-trans isomerase | | | 0.11 | 0.39 | 0.05 | 0.62 | | | | | 0.25 | |
| 175 | 12196 | Peptidylprolyl cis-trans isomerase | | | | | | 0.19 | 0.15 | 0.14 | 0.16 | | | |
| 176 | 13382 | Peptidylprolyl cis-trans isomerase | | | | 0.25 | | 0.06 | | 0.07 | 0.04 | | 0.87 | 0.15 |
| 177 | 16461 | Peptidylprolyl cis-trans isomerase | | | | 0.19 | | 0.15 | 0.15 | | 0.04 | | 0.04 | 0.74 |
| 178 | 17611 | Peptidylprolyl cis-trans isomerase | | | | 0.24 | 0.11 | 0.27 | 0.41 | | | | 0.99 | |
| 179 | 19776 | Peptidylprolyl cis-trans isomerase | | | | | | 0.13 | | 0.07 | 0.16 | | 0.05 | 0.61 |
| 180 | 20659 | Peptidylprolyl cis-trans isomerase | | | | | | | | | 0.15 | | 0.19 | |
| 181 | 22559 | Peptidylprolyl cis-trans isomerase | | | | | | | 0.11 | 0.14 | | | | 0.20 |
| 182 | 24188 | Peptidylprolyl cis-trans isomerase | | | | | | | | | 0.23 | | | |
| 183 | 27973 | Peptidylprolyl cis-trans isomerase | | | | | | | | | | | 1.01 | |

TABLE 13-continued

Pine in silico data.

| SEQ ID | ConsID pinus Radiata | Family | 1 | 2 | 3 | 4 | 5 | 6 | 7 | 8 | 9 | 10 | 11 | 12 |
|---|---|---|---|---|---|---|---|---|---|---|---|---|---|---|
| 184 | 1353 | WD40 repeat protein | | | 0.44 | | 0.05 | 0.73 | | | 0.11 | 1.07 | 0.70 | 1.32 |
| 185 | 1978 | WD40 repeat protein | | 0.14 | | 0.05 | | 0.44 | 0.11 | 0.21 | 0.27 | 0.36 | 1.46 | 0.82 |
| 186 | 2810 | WD40 repeat protein | | 0.42 | | 0.79 | 0.11 | 0.39 | | 0.27 | | 0.36 | 1.69 | 1.03 |
| 187 | 2811 | WD40 repeat protein | | | | | | | | | 0.14 | | 0.09 | 0.14 |
| 188 | 2812 | WD40 repeat protein | | | | | | | 0.15 | | | 0.18 | 0.04 | 0.16 |
| 189 | 3514 | WD40 repeat protein | | | | 0.63 | | 0.06 | | 0.14 | | 0.18 | 0.48 | 0.56 |
| 190 | 4104 | WD40 repeat protein | | 0.14 | | 0.25 | | 0.27 | 0.37 | 0.36 | 0.19 | 0.18 | 0.39 | 0.53 |
| 191 | 5595 | WD40 repeat protein | | 0.14 | | 0.25 | | | 0.15 | 0.14 | 0.07 | | 0.23 | |
| 192 | 5754 | WD40 repeat protein | 0.31 | 0.14 | | | | 0.06 | | 0.07 | 0.16 | | 0.10 | 0.16 |
| 193 | 6463 | WD40 repeat protein | 0.16 | 0.56 | 0.22 | 0.43 | | 0.81 | 0.53 | 0.21 | 0.08 | | 1.00 | 0.70 |
| 194 | 6665 | WD40 repeat protein | 0.31 | 0.28 | | 0.45 | 0.44 | 0.96 | | | 0.07 | | 3.37 | 2.68 |
| 195 | 6750 | WD40 repeat protein | | 0.14 | | 0.59 | 0.05 | | 0.37 | 0.42 | 0.04 | | 0.18 | 0.52 |
| 196 | 7030 | WD40 repeat protein | 0.31 | | | 0.40 | 0.54 | 0.45 | 0.37 | | 0.07 | | 1.58 | 3.41 |
| 197 | 7854 | WD40 repeat protein | | | 0.11 | | | | | 0.14 | | | 0.05 | |
| 198 | 7917 | WD40 repeat protein | | | 0.22 | 0.39 | | 0.13 | 0.15 | | | | 0.18 | 0.56 |
| 199 | 7989 | WD40 repeat protein | | | 0.11 | | | | | | 0.04 | | 0.11 | |
| 200 | 8506 | WD40 repeat protein | 0.47 | | 0.33 | | 0.11 | 0.86 | 0.19 | 1.28 | 0.04 | | 1.23 | 3.12 |
| 201 | 8692 | WD40 repeat protein | | | | 0.21 | | 0.06 | 0.11 | | 0.15 | | 0.10 | 0.87 |
| 202 | 8693 | WD40 repeat protein | | | 0.11 | 0.80 | | 0.25 | | 0.14 | 0.18 | | 0.53 | 0.31 |
| 203 | 9170 | WD40 repeat protein | 0.16 | | 0.11 | 0.05 | | | | | | | 0.05 | |
| 204 | 9408 | WD40 repeat protein | | | 0.33 | | 0.05 | 0.41 | 0.15 | 0.14 | | | 0.41 | 0.33 |
| 205 | 9522 | WD40 repeat protein | | | 0.11 | | | | | | | | 0.18 | |
| 206 | 9734 | WD40 repeat protein | | | 0.11 | 0.05 | 0.11 | 0.15 | | 0.07 | 0.25 | | 0.11 | |
| 207 | 9815 | WD40 repeat protein | | | 0.11 | | | | | | | | 0.18 | 0.14 |

TABLE 13-continued

Pine in silico data.

| SEQ ID | ConsID pinus Radiata | Family | 1 | 2 | 3 | 4 | 5 | 6 | 7 | 8 | 9 | 10 | 11 | 12 |
|---|---|---|---|---|---|---|---|---|---|---|---|---|---|---|
| 208 | 10670 | WD40 repeat protein | | | | 0.40 | 0.16 | 0.11 | | | 0.16 | | 0.34 | 0.31 |
| 209 | 11297 | WD40 repeat protein | | | | 0.53 | | | 0.15 | | 0.16 | | 0.05 | |
| 210 | 13098 | WD40 repeat protein | | | | 0.19 | 0.11 | 0.54 | 0.31 | 0.14 | 0.26 | | 1.85 | 0.14 |
| 211 | 13172 | WD40 repeat protein | | | | | | | | | 0.04 | | | |
| 212 | 13589 | WD40 repeat protein | | | | | 0.11 | 0.06 | | 0.21 | | | 0.05 | 0.37 |
| 213 | 13608 | WD40 repeat protein | | | | | | 0.11 | | | 0.04 | | 0.59 | 0.33 |
| 214 | 14299 | WD40 repeat protein | 0.16 | | | 0.05 | | | | 1.09 | | | 0.38 | |
| 215 | 14498 | WD40 repeat protein | | | | 0.21 | | | | | | | 0.44 | 0.30 |
| 216 | 14548 | WD40 repeat protein | 0.16 | | | | | | | | 0.11 | | 0.11 | 0.82 |
| 217 | 14610 | WD40 repeat protein | 0.16 | | | | | 0.27 | | | | | | |
| 218 | 16090 | WD40 repeat protein | | | | | | 0.43 | | | 0.04 | | 0.37 | 0.85 |
| 219 | 16722 | WD40 repeat protein | | | | | | | | | | | 0.10 | |
| 220 | 16785 | WD40 repeat protein | | | | 0.05 | | 0.13 | | | | | 0.38 | 0.50 |
| 221 | 17094 | WD40 repeat protein | | | | | | 0.29 | 0.15 | | | | 0.24 | 0.81 |
| 222 | 17527 | WD40 repeat protein | | | | | | | | | 0.04 | | 0.10 | |
| 223 | 17591 | WD40 repeat protein | | | | | | 0.14 | | | | | 0.10 | |
| 224 | 17769 | WD40 repeat protein | | | | | | | | | | | 0.39 | |
| 225 | 18047 | WD40 repeat protein | | | | 0.05 | 0.22 | 0.98 | 0.15 | 2.68 | 0.07 | | 0.19 | 0.80 |
| 226 | 18414 | WD40 repeat protein | | | | | 0.16 | 0.15 | | | 0.34 | | 0.23 | 0.19 |
| 227 | 18986 | WD40 repeat protein | | | | | | 0.41 | | | | | 0.15 | |
| 228 | 19479 | WD40 repeat protein | | | | | 0.05 | | | | | | 0.28 | 0.32 |
| 229 | 20144 | WD40 repeat protein | | | | 0.43 | | | 0.29 | | | | 0.05 | |
| 230 | 22480 | WD40 repeat protein | | | | | | | 0.15 | 0.27 | | | | |
| 231 | 23079 | WD40 repeat protein | | | | | | 0.13 | | | 0.04 | | | |

TABLE 13-continued

Pine in silico data.

| SEQ ID | ConsID pinus Radiata | Family | 1 | 2 | 3 | 4 | 5 | 6 | 7 | 8 | 9 | 10 | 11 | 12 |
|---|---|---|---|---|---|---|---|---|---|---|---|---|---|---|
| 232 | 26739 | WD40 repeat protein | | | | | | | 0.15 | | | | 0.18 | |
| 233 | 26951 | WD40 repeat protein | | | | 0.21 | | | | | | | | 0.20 |
| 234 | 26529 | WEE1-like protein | | | | | | | | | | 0.04 | 0.18 | |
| 237 | 888 | WD40 repeat protein | | | | | | | 0.11 | | | | 0.18 | |
| 238 | 14166 | Cyclin-dependant kinase inhibitor | 0.16 | | | 0.05 | | | | | | | 0.05 | |
| 239 | 3189 | Cyclin-dependant protein kinase | | | | | | 0.06 | | | | | | |
| 240 | 9356 | Histone acetyltransferase | | 0.11 | | | | | 0.22 | | | | | 0.46 |
| 241 | 65 | Histone deacetylase | 0.16 | | | | 0.22 | 0.27 | 0.22 | | | | 0.24 | 0.34 |
| 242 | 14197 | Histone deacetylase | 0.16 | | | 0.33 | | | | | | | 0.05 | |
| 243 | 9081 | Peptidylprolyl cis-trans isomerase | | 0.11 | | 0.05 | | | 0.29 | | 0.26 | | 0.69 | |
| 244 | 13417 | Peptidylprolyl cis-trans isomerase | | | | | | 0.06 | | | | | 0.59 | |
| 245 | 5755 | WD40 repeat protein | 0.16 | | | | | | | | | | | |
| 246 | 6670 | WD40 repeat protein | | 0.14 | | 0.05 | | | | | | | | |
| 247 | 7027 | WD40 repeat protein | | 0.14 | | | | | 0.15 | | | | 1.30 | 0.15 |
| 248 | 7276 | WD40 repeat protein | | 0.14 | | | | | 0.11 | | | | 0.05 | |
| 249 | 7390 | WD40 repeat protein | 0.31 | 0.14 | | | 0.11 | | 0.44 | | | | 1.29 | 0.38 |
| 250 | 12648 | WD40 repeat protein | | | | 0.05 | | 0.06 | | | | | 0.05 | 0.94 |
| 251 | 13171 | WD40 repeat protein | | | | 0.19 | | 0.63 | | | | | 0.19 | 0.34 |

Table 13, the following numbers 1-12 represent the following tissues: 1 is bud reproductive; 2 is bud vegetative; 3 is callus; 4 is cambium; 5 is meristem vegetative; 6 is phloem; 7 is reproductive female; 8 is reproductive male; 9 is root; 10 is vascular; 11 is whole; and 12 is xylem.

TABLE 14

Oligo Table.

| Oligo SEQ ID | Oligo ID | Microarray Oligo Seq |
|---|---|---|
| 521 | Euc_003910_O_4 | GATTTTAAGTAACTCAATTAGCAGTTCCAACATTAAACCATTATTATTACCCCTTTTATC |
| 522 | Euc_019213_O_1 | CTCAAAAAGTACTTGGATGCGTGCGGTGACAACGGACTCGAACCGTACACTGTCAAATCT |
| 523 | Euc_036800_O_4 | TTGTCAAGTTGCAGGACGTAGTGCACAGTGAGAGGCGTCTATATCTAGTTTTTGAGTACT |

TABLE 14-continued

Oligo Table.

| Oligo SEQ ID | Oligo ID | Microarray Oligo Seq |
|---|---|---|
| 524 | Euc_040260_O_1 | GAAGAAATTATATAACTAGATACAAGGTTAGCTAGGTATATAATAGCGGTACAAGTCTTT |
| 525 | Euc_041965_O_1 | GGACAAATCAAGTAGAACTTCTCTCGGCAGCATCAGTTTTTCTAATCCATGCCTTGTTGC |
| 526 | Euc_002906_O_1 | CTCAGTTCTGATAATGCCTCGGATATATGGCCGAGTGTTCGCTGGACGGCCTCTTATGTT |
| 527 | Euc_001518_O_3 | GGAGATTCTGAACTGCAACAGCTCCTACACATTTTCAGACTGTTGGGTACTCCAAATGAA |
| 528 | Euc_008078_O_2 | GACTGGTAAAATCGTTGCACTAAAAAAGGTCCGGTTTGACAACTTGGAACCTGAAAGCGT |
| 529 | Euc_009826_O_4 | AAACACCAATCTATCAACACTGTCGAGTTTAGTCACTAGTAGAACCGGAGATAACAAACA |
| 530 | Euc_010364_O_1 | CTATGATCCTGAGCGCAAGCAAGTTATGACCAATAGAGTCGTTACACTATGGTACCGAGC |
| 531 | Euc_011523_O_1 | TGTTGTGAAGGTAGTTATAGCCATCGATTAGACAGTGATTAAAGTAGTACCCGTGCCAAT |
| 532 | Euc_024358_O_2 | CCACATACAAGAGTTGTTACGCTACACATCCTATACCATCAAAGGAACGTTGGAATGCCA |
| 533 | Euc_039125_O_3 | TATGATCGACACAAGCATTTTGTGTTGGAGCCTCAGCTAATTGTATGTCATCGAGTACTT |
| 534 | Euc_005362_O_3 | AAAATTTTTGCTACGGATAATGTTGTGAGGCGAGGCAGTCGAAATTACGGAGGTTGACTT |
| 535 | Euc_044857_O_1 | ATGCAGGGATCAAATTTGTGAGTACTACGTAAAATTTTGCTACGGAGGCGAGGCAGTCGA |
| 536 | Euc_001743_O_1 | GAAGAATACAGGCTCGTACCTGATACACTGTACCTGACTGTTAACTACATAGATCGGTAT |
| 537 | Euc_012405_O_1 | TCCACCCTAAATGCGATACGTGAAAAGTATAGACAACAGAAGGTAAACTATTCATTACTG |
| 538 | Euc_003739_O_2 | AGGCTTCTAGTTGCGTTCCCCCAAACTACATGGATCGGCAGCAGGATATTAATGAGCGGA |
| 539 | Euc_022338_O_2 | GAGAAAAATGACAGATTGATATCGATGATGATGACTGTCGTGTCATCAGTAGTGTGCTTT |
| 540 | Euc_028605_O_5 | TTTCCAATTGTAGTTCGTCTTTTATTGTAACAATAAATTGATAGATACTGATTCGAAATA |
| 541 | Euc_041006_O_1 | ACATTTATGCTAACTATAGGAGAACGGAGAATTGTAGCTGCGTCTCTGCTAACTACATGG |
| 542 | Euc_006643_O_1 | TTCTGGCTTAAAGGCTATTCTTTGTGCACAATGACCTGAGGGAGGTCTCGACAGACCACT |
| 543 | Euc_045338_O_1 | TTCATCCGGGTCCTGGTTATCATACTCTTATATATGTTGGGGAATAACGGTTCATATGTT |
| 544 | Euc_046486_O_3 | GGGTGTGCTTAATAGTTCTTATTAGTCTTAGCTTATTATCTTTGATTGGACATGCTATAA |
| 545 | Euc_012070_O_2 | CTTGCTAAGTAGACATGTTATATTTCTAATGCTTTGAGAACAATATTACAGTATAATTAG |
| 546 | Euc_006617_O_2 | AATCATCGACTAGACCGATGGTCAAAGTGGTAATCATGTAATTAAACGCGTTTGTCATTG |
| 547 | Euc_007827_O_2 | ATGGAAAAATCTATGGATATGAAGGATTGAAGATATCCGTCTGGGTAAGCTGTGTATCAT |
| 548 | Euc_008036_O_3 | TTATGATTTGAGAAAACCCTTGCAGGCTGCGATTTGCGGATCATGACAGCATAGTTTTGC |
| 549 | Euc_001596_O_2 | GTTTTGTTGTGAGGGCTTGGTAGGTTTTCATTATATTGTAATGTCGACGACAGAGATTTT |
| 550 | Euc_005870_O_3 | CCAATTAATGTTACTGCTCAAGCTGACGTACCTGCGAAAAAAGCACCAGTGACTGCTAAT |
| 551 | Euc_006901_O_3 | TGATGTCAAAACGTAGCTCTTTTTTGTGTGAGCTATCCTGCTAAATTAAACCTCAGCAAA |
| 552 | Euc_006902_O_1 | ACATGAGTATTATGAATACTTCGGTCCTGACTATACACTTCATGTTGCTCCGAGTAACAT |
| 553 | Euc_007440_O_2 | GAATTGGCGATCACAATCTACTGTAGTCAATACTCAAGTGGGAGGTGTAAATAGATTCCA |
| 554 | Euc_008994_O_1 | GATCATGTGTAATCAGTATATCAGGTTAGAAACAGTACTCTTGAGCTTAGCGGGCACTGT |
| 555 | Euc_024580_O_2 | TCCTGTGAAGGTGGTCGACTCAATCAAAAGGTACCTTGTAGATAAGGTACCTTTTCTCAA |
| 556 | Euc_037831_O_5 | GCATTTATACGACGGATAGAGTCATGACCGTATCTTTCCATAAGTTTGGGGACTTCTTC |
| 557 | Euc_034958_O_3 | CCTCGTTTCTTTGCGGTTCGGACGCATCATGGATGTATCTCCAAAGAGTAATCTGTCGAT |
| 558 | Euc_022967_O_2 | AATTCAGATCTATTAGTGAAAGTTGGCATGAGTCTCAATCTTAGGGGAATACAGTACGGA |
| 559 | Euc_008599_O_3 | TGATATGAGTATCATAACTCGGATGGTGACAACTTTGTACTACGGTCGGCACCGGTAGAT |
| 560 | Euc_009919_O_1 | CATATACAATCTTAGTGGATTAGCTGAGGTCGAAACTGACAAGAGTGATCGCCCGTTGGA |

TABLE 14-continued

Oligo Table.

| Oligo SEQ ID | Oligo ID | Microarray Oligo Seq |
|---|---|---|
| 561 | Euc_015820_O_2 | CATGGCTAACGCTGGCCCTAGCACTAATGGGAGCCAATTTTTCATATGCACTGTAAAGAC |
| 562 | Euc_008327_O_2 | AACAAAGTCTACCTTGACATTAGCATCGGTAACCCTGTCGGGAAACTAGTCGGAAGAATT |
| 563 | Euc_004604_O_2 | TGTGCTTGGATATACTGTATAAGCATTCTATATTATGCTTGTTGGCTTCGTTTTGAGGGA |
| 564 | Euc_000966_O_1 | TTAACGTCGACCGCTTCTCTGCCCCTTGAATTTTCCCGAGAAAACCAGGAACCTGCCAAA |
| 565 | Euc_001031_O_1 | TGTTGAATACGATGTATTATAATGTTGGTGTCTTGGTGAAATACAGAATTATGCTTGCGT |
| 566 | Euc_004603_O_2 | ATCGCTGTGGCTGATCTCGTCGCTCCGGCTTTTCATAAAAATCATGGCTGAGGCAATCGA |
| 567 | Euc_005465_O_2 | CTCGCAACCCTATATCTCGCTCAGGCGAAGAAGTCTGAGGATTTGAAAGAGGTGACTCAC |
| 568 | Euc_006571_O_1 | TGTTTTTGGGTACACGCAGTTAGGATAACTAGCATGAAAGCCCGATCCCGCATATACAGG |
| 569 | Euc_006786_O_2 | GAGGACTAGCCGGAACTTCATCGAACTCTCTCGGAGGGGTTACTACGATAACGTCAAGTT |
| 570 | Euc_007057_O_1 | GATGGCTAGCACTGTGTAGAAAGGTGAATTTAAAGTACTTGTCTACACTGCTTATTAAAT |
| 571 | Euc_008670_O_2 | TGAGACTGTCTTGGCGTGTATTTTGGAATAAACTATTATCACGTTTTGTTAAATATAATA |
| 572 | Euc_009137_O_3 | TTACAAAATGGCTCTCAGAAAGTATCGAAAGGCCCTGCGCTATCTGGATATCTGCTGGGA |
| 573 | Euc_010285_O_2 | AATTTTATGTTTGCTACTGCTTAGTGCTTAATGGACTTGCGTAGGTATTCAAATTACAGA |
| 574 | Euc_010600_O_1 | TGGAACCGTGGTATCGGCTGACGTTATCCGTGATTTTAAGACTGGAGATAGTTTATGCTA |
| 575 | Euc_011551_O_2 | CTTTGATGTATCCTCAGTGTACTGCTTTTAGCTATGTATAGATCGAGTCAACTCATTGAA |
| 576 | Euc_020743_O_3 | TTTTTATTATTTACCTTCGCCTTTACGCTGCATACGTTAATAGGTTATTATTTCCTTCAA |
| 577 | Euc_023739_O_1 | ATTTGTCCATGACAATCGTAGTCGAAGACACGATACGCTCTTAGATGGTACGGAAATCTG |
| 578 | Euc_031985_O_2 | TGAATAGAGATAACTTTTCTGAGTGTGAATTGGATATTACGTTGCAAATAGCCGAATGAA |
| 579 | Euc_032025_O_2 | GCTTTAGGTTAGGGATCCCTGTAAGCTGATGATAGATATTGGAGATGGTACTTGTAAGAT |
| 580 | Euc_032173_O_1 | TGTTGTGTTTGGAAAGGTGCTGTCTGGGATGGATGTTGTCCACAAGATTGAGGCTGAAGG |
| 581 | Euc_009143_O_1 | GGAAAGCGGGGAATGAGCATGTGGATATTATCTCTTTCTACAATGAAATATTCATTCCTT |
| 582 | Euc_000349_O_1 | CATCAGGACGTTGACTCTAATTAAGACATATGTGACAGAGCGCCCTGTTAATGCGGTTAC |
| 583 | Euc_000575_O_2 | CTTTAGGTTTGATCTGTCTGTTTTGTCTATCCTGCGAGTTTCGAGCATGTGCGTGTGTGA |
| 584 | Euc_000804_O_1 | CAGCCCCAATAGATACTGGCTCTGTGCCGCTACTGAGAACAGTATTAAAATCTGGGACCT |
| 585 | Euc_000805_O_2 | AAGAATGAAGCTGATATGAGTGATGGAACTACGGGGCCATGAGCTCAAATAAGAAGGTC |
| 586 | Euc_000806_O_1 | TGACTACAATTAGCACCTCACCATTATCGAACTGTATAATTGTGCTTGCCTGCTATTATT |
| 587 | Euc_002248_O_4 | TTGAAGCGGAAATATATATTTATGCTACTACATAAGTAATGTACTACTTGACAAGATGAG |
| 588 | Euc_003203_O_1 | TACTCGATGTGGTATAGAATTTATCCAATGTACTCCTAAATGTAGATACATCGTGTATTG |
| 589 | Euc_003209_O_2 | GCTTCGTCTGATACCACTATCAAGATAATAGGCGTGAGCAATAGCTCTGGATCACAGCAC |
| 590 | Euc_004429_O_4 | GGTCGGCTTGCTAGTGTATCTGATGACAAGAGCATATCACTCTATGATTACTCATGAAGG |
| 591 | Euc_004607_O_3 | GAAAGGAGAAAGCATGGAGATCGATCTCGGAAACCTCGCATTCGACGTCGATTTTCATC |
| 592 | Euc_004682_O_1 | GATTCAGTACCCGGATTCGCAAGTCAACCGGTTGGAGATAACTCCACATAAGCGGTACCT |
| 593 | Euc_005786_O_1 | TTCCATGTATCAAGCCGCATCAATGTTTGTCGCTGCAATTAACATGTGTGCAGTCGATCC |
| 594 | Euc_005887_O_2 | TTCAGCGCATTGTGTAAATGTAGATAGGTGATATATTTCTCGTTGCAATGTAGGGTAAGA |
| 595 | Euc_005981_O_2 | TCCAATAATCACATTTACCATCAACAGGCATCAGCAACATACTGTTGTAGTGTAATTAAT |
| 596 | Euc_006766_O_1 | GGGCATTCTGACTACCTGCACTGTATAGCTGCACGGAACTCTTCTAGTCAGATTATAACA |

TABLE 14-continued

Oligo Table.

| Oligo SEQ ID | Oligo ID | Microarray Oligo Seq |
|---|---|---|
| 597 | Euc_006769_O_1 | AATCGTCTGGTAGATTGTCAAAAACTAATAAACCTGTGATTGATCCGGATTCTAGTAATG |
| 598 | Euc_006907_O_2 | AGTTGAGGATTCTCCACTATGACAGCTCTCATGGCTTGAATCTAAAGTCATCTGGTTTTC |
| 599 | Euc_007518_O_1 | GAACAATCATTCTGTAGAACACTAGAGTCTATATGCTTGACTGTATCGGTTAATTAATTC |
| 600 | Euc_007717_O_1 | AGATAGCGATAGAGTTATACTGCATGTACTGAGGTAAATGTTTTGATTACTCCACCCAAT |
| 601 | Euc_007718_O_1 | AAGAATTGTTAGGAGGTGTATACTTTCTGTAACTGTATTCAATGAGCATACACCTGACGG |
| 602 | Euc_007741_O_2 | CAACTCATATAATGACTGGATTCTGGCAACCGCGTCTTCAGACACAACAGTTGGACTATT |
| 603 | Euc_007884_O_1 | AGTGTAAAAGGATGCCCCTAATAGATTATATGCCAAGTGTAGTATATATAATAGTGCTTT |
| 604 | Euc_008258_O_2 | AAGAATCTACAGTTGTCTTATGCTACTCTATTACTCAATTATGCTGTGCTATTGATTGAG |
| 605 | Euc_008465_O_4 | TCTGAATACATACTTTGTGGTCTCTATAAAAGACCAATGATACAGGCATGGTCATTAATT |
| 606 | Euc_008616_O_5 | TAAATCTTCTCATGTGCCTGGCGTAAATTTTGCAGTTATTACTAGACCAAGATAGTTTCA |
| 607 | Euc_008690_O_4 | ACATGGATTCGATCAATCGCCACATGACAACTAAAACAAGCGGTTCACGTGATTGTAATT |
| 608 | Euc_008708_O_4 | AGATGAGTATGCTCGGGTGTATGATATTCGCAATTACAAGTGGAATGGATCGCATAATTT |
| 609 | Euc_008850_O_5 | TCTTTGATTCTGTTGTATGGTGTATCCTTATTGTATCTTCTATCTGCCCCCCATGTAATTC |
| 610 | Euc_009072_O_1 | TTCGTTGTGTAGTACTGGGAGTTACTACTTGTATGTATGTAAATCATGTGGCGTCTGTCC |
| 611 | Euc_009465_O_1 | GGAGATGTGTAATATGTCTGAGCGGTCACACTCTAGCTGTTACATGCGTAAAGTGGGGAG |
| 612 | Euc_009472_O_3 | CCACCGTTGCGTAACTCGAATAGCCGGATTTTCGTTTTCGTTTTTATTTCCCCGTTAATT |
| 613 | Euc_009550_O_1 | TGAGATGCTCTGTGTGAGGACTTTTACGAAACTTGAATGGCCCGTAAGGACAATAAGCTT |
| 614 | Euc_010284_O_3 | TGGGTTGTTGCGACGGGTTCTACAGATAAGACTGTTAAGTTATTTGATCTACGCAAGATC |
| 615 | Euc_010595_O_1 | GCAGAGGTGCCTACATATGCTTTAGAATGCTAGTAGCTTGGAAGTGCAACACGCTCGTGA |
| 616 | Euc_010657_O_1 | AGTAAAGTTTAACGACTATGCATCTGTCGTAGTATCAGCCGGCTATGATCGTTCAGTGCG |
| 617 | Euc_012636_O_2 | CGTTAGGATAGTCTTTAAAGGAGTTGGTGATTATTGATTTCCACCCAATATATGTAGCGT |
| 618 | Euc_012748_O_2 | GAGCAAGCTACTTACAAAAATCGACAGCGTCTTTACCTATCTGAACAGACAGATGGCAGT |
| 619 | Euc_012879_O_2 | TCCTTCCGACAAGTACCGTATTGCAAGTTGTGGTATGGACAATACGGTTAAAATCTGGTC |
| 620 | Euc_015515_O_1 | TTTCACTCGATGACGGTTGGCCGGATAAATAATCGCTTATATAGTCCTAATAAGTTCCAT |
| 621 | Euc_015724_O_3 | ATATGTAGGTGGTAGAGGTGTGGATATTGCATAGACCGAACCTCCGCAGGTCCGCATTCT |
| 622 | Euc_016167_O_1 | CCATTGAACTACTTATGGATTACTTTATACATGAAATATCATGCCGGAGTAATTTTGAGT |
| 623 | Euc_016633_O_3 | AGCATTAGAGACCTGGATTTTAGTCTAGATTCAGAGTTTTTGGCTACGACATCTACTGAT |
| 624 | Euc_017485_O_3 | AAAGGTTTATCCCTCATTGGATTTGATATATAAACTGAGAGTGTTTTGCCCCCCATTAAA |
| 625 | Euc_018007_O_1 | GTACAGCGTGTATTTCTTGTTACGATACTTGAGGGGTTAGAGGCACCTACGAATTAGGAA |
| 626 | Euc_020775_O_3 | ATATCCTTATGAATGAAGTTTGGATGATAAGTGGCGCCAGACTTTCTACTCACCCTTTTT |
| 627 | Euc_023132_O_3 | TGATCACATCGTTGTTTGCAATAAGACGTCATCAATTTATATCATGACTCTACAGGGACA |
| 628 | Euc_023569_O_2 | TTTTCCCAGTGTACTGCGAGAGTGATGCTACATAAGTTTACTCTTGTGTCTAACTTTTCC |
| 629 | Euc_023611_O_1 | AGATTCTACAGATGGCGCTATACGAGCTGTTATACGGACATTTTATGACCATACACATCC |
| 630 | Euc_024934_O_3 | TGCTACGGGAAACCAGGACAAAACTTGTAGGATTTGGGACATACGAAACTTATCTAAGTC |
| 631 | Euc_025546_O_1 | CAAGTCATATAGTTACAGTGTCGCATGACAGAACAATTAAGCTCTGGACTAGTAACGACG |
| 632 | Euc_030134_O_2 | TGCCACATCGTAACCATCATAGCACTTATCATCTAATTATGGTGAAAGGGAGTTATATAT |
| 633 | Euc_031787_O_5 | GTTTATACTTATAAACAACAGAGAGACAACTGTACAGGTGTTGTAAACACTCCCAGTGTG |

TABLE 14-continued

Oligo Table.

| Oligo SEQ ID | Oligo ID | Microarray Oligo Seq |
|---|---|---|
| 634 | Euc_034435_O_1 | CTGTGTTTTAGCCCGAGGGCCAATCACTTAGTTGCTACTTCGTGGGATAATCAGGTACGG |
| 635 | Euc_034452_O_3 | GCAAAGTAGAGTTTAAGTTTCGTTGTGCTTGGACCGGAAAACTCACATGCTTAGAGTTTA |
| 636 | Euc_035789_O_5 | AAGATTTGGGCATAACTTGTATGAACTTTTTCTGTTGTCGACACTGTAATTACACGAGCT |
| 637 | Euc_035804_O_4 | AAACAGATGCATGTATGCTTCATAACTCTATAGATATGGAAATGTCACTGTACACTGATC |
| 638 | Euc_043057_O_2 | TTATTGGTGCACAGGACGGAAAATTGCGCATATATTCTATTTCAGGTGATACATTAACAG |
| 639 | Euc_046741_O_1 | AGGCACAGACACTTGCCTAAACCAATATACAAGGCAGGTATTCTAAGGCGCACCGTGAAT |
| 640 | Euc_047161_O_4 | CATGCGAAGGTTTCTGGGAATTTTCAGTAGAAAATTCGGTCGTGGCGGCCATCCTCGATA |
| 641 | Pra_001766_O_1 | TTAAGCTGATAGCTTTAGTTCCTACGTGGAATGTATAAATGCACCATTGTCCATAAGGCA |
| 642 | Pra_002927_O_2 | GGATGCTCTGGTTACATGACTACTCCTTAGGGAATCAGTCAGACATTTTAAATAACTTCC |
| 643 | Pra_007642_O_2 | TCATTAAGCGGTACTGGCAGAGGACATGTCTATTTATACAAGCAAATGGTCCTATTGGCT |
| 644 | Pra_013714_O_1 | ATGTTGGTCAGACCTCAAATATTGTACTCCCCACACTAGGGAGCATTTACGGTGAATATA |
| 645 | Pra_016332_O_1 | TCCTCTCGACCCTTAGAGTCCTCTGCGAATCTTGTTGTTAGTTACTGTGTACGCTGTAAC |
| 646 | Pra_021677_O_3 | AAGCATGTTTTGAATTTATGGTGGTGGCATGTGGATATTTGAACTTGGTTGAGAAAAATT |
| 647 | Pra_027562_O_2 | CATTCCTATTGAAGGGTCAACCTTTAATTTTGGCTAGCAGGACTGTATAGGATTATATGC |
| 648 | Pra_001504_O_2 | TTATTGTATTTTAGATTCTTGATGGCCATCTAAACTTCTGGCTGCTTGGTGCAACATTGA |
| 649 | Pra_015211_O_2 | ATAGCTAATGATTCCATGCTATCCATGGTATCTACTTCACGATAATAAAGGTCTTAGTCC |
| 650 | Pra_020421_O_2 | CACCTAATAGGCCTGAGTATTGCTCACCACTATGCTGATATGGGGAGCAATAACGTTAGT |
| 651 | Pra_003187_O_2 | TTTCTTTTCACTTTGTACTAATGATCATTGTGACCACAAAATCTTTATACACAATACAGA |
| 652 | Pra_015661_O_1 | CTTGTCACTATCCTCATATTGATATCCACCTCGTGTATGTTGTGGGGTGGCAAAATTACTT |
| 653 | Pra_013874_O_1 | TATTTTAACTCAGCGACTTACCAGCCTAGTAAGCAATGGGGAGCTTGCATGTATTAGTTT |
| 654 | Pra_014615_O_1 | ATTCGTCCTGGTCCTTTAGGACATGTACTTATGTCCATGCAAGTGCTTCTTGCCTAAGCT |
| 655 | Pra_004578_O_2 | TTCTAGGCGATATATATCGCCGTAACTTTGGATGTGTTAAGAATATAGGGGATCATTAGC |
| 656 | Pra_023387_O_3 | AGTTGCAGAGTGTGTAGCAACTGATGAGCATAGTTGTTATGTTTCTCAACTCAGTTGCAC |
| 657 | Pra_006970_O_1 | AAGAAACTCATACACTGGACAGGCCAACCTTCCAAATATGTGTTTAGAAAACCTTTGTCT |
| 658 | Pra_010322_O_1 | AAGGGGTGCTATCCATATCTAGAATCTACCATGCTCAATGAGGTATCTTCATTAGTATAC |
| 659 | Pra_022721_O_1 | ATCTAATGCTAGTTTATTGATTTCTATGATCCAAGACCTCGTCATAGATCAAGTGCCTAG |
| 660 | Pra_023407_O_1 | TTGTTATTAAATACCATTCAATATGCTTATGATTCATGAATGCTTAAGAGATTCTGCTGC |
| 661 | Pra_001945_O_2 | GCTTCTAAACTGTAGAAGCCTGTTATCTTTAGACTCGTGGTTATGTGAACTACTTTTACA |
| 662 | Pra_008233_O_1 | GGCTGTGGGATTCGAGCCTGATGGTTATGCACTGTGGCCAGCAAGATGTTGAAGTTTTA |
| 663 | Pra_008234_O_4 | GCCTGATGGTTATGCACTGTAAGTGATCTGATTTGATTAACTATTTTATCAATTAATTTT |
| 664 | Pra_022054_O_2 | ATGGTCATTATCCGAGATAGTGCGCTTTGTCATGGGAAAATGACTATTGAATGTGAGTTT |
| 665 | Pra_012137_O_2 | TTTTCTGGTGCATCCTTAACACAGCTTGGTTACATGGTGAATTACAGTATTTGAAGGAGT |
| 666 | Pra_012582_O_2 | AGATTTAATGCCACTTAGGTGATCGGTGACCCACTTGTACATATAGATGTTGGCGATGTT |
| 667 | Pra_015285_O_2 | AAGAAATTCATCAATTCTTTGAAATTATTGTTCCCTTTTGATGCGGCCCCTTTCTGGAGG |
| 668 | Pra_017229_O_1 | TAAAGTATATTTTAGCCGCTGTTGTTGTAAATTTATGTTTTTCATTGCTATCAACATTTA |
| 669 | Pra_020724_O_2 | GGTTTTCCTATAAGATGTATGAATTCGCACTGTGGTGCAATTTTATGAATTAAACTCAAA |

TABLE 14-continued

Oligo Table.

| Oligo SEQ ID | Oligo ID | Microarray Oligo Seq |
|---|---|---|
| 670 | Pra_004555_O_1 | TTTACTATTCCGTCTGGGCTTAGAGATGTACGTTAATTGGTCATTTAAGACGACTCAGTT |
| 671 | Pra_004556_O_5 | TCAAATCTAGTCAATATCCGTGTTGAGCTAAACAAGCGCTGAAAGTTTGCTCGAATCAGC |
| 672 | Pra_005729_O_2 | AGAAAGTTGTGTACTAATTTGTATTGTAACGTCCATTTATCCAACGAGTCCTCCATTCAT |
| 673 | Pra_007395_O_3 | CAGTACTGTATTCGAAGATCCTGAAAATTTACTAAAACAAATGGAATATCAACAACCTAG |
| 674 | Pra_009503_O_1 | TTGCTCTATATAATTTGTGCTCGTGTGTGTACTTGAAGATCCATCCTCACATAGTCCAAT |
| 675 | Pra_011283_O_1 | GTGTGTATAGTTTTATAACACTCTATGGTATCACTACCACTATGGGCCTGTTTAGTCCAA |
| 676 | Pra_012322_O_3 | GAAGCAGAATCAGCTTTGACCAGTATTTAGTGTCTTGTATACAATTCTTGTTTCAGTGAA |
| 677 | Pra_023236_O_3 | AAATCAAGATTAAAATCCGAAACCAAGGCTAACCAGCAAACTGTGAGGTGTACATTGTTG |
| 678 | Pra_000171_O_2 | TTCCAAGCAGAAGGGCACATGTTGTGACATCAAGTAGTAGATTGTTCTGCAGATTCTGGT |
| 679 | Pra_000172_O_1 | GTTAATGTAATACATTTAGTTTTTAGATAACTGTTAATGTGTAGTAAAGCACTAGGAAGA |
| 680 | Pra_001480_O_3 | GAGGCTTCAAAGGTTTTTGTGTCTTTTCTAGTTATTATAAACGCTTCATAGGTTCCTAGG |
| 681 | Pra_001692_O_2 | GAAGATTGTAAGTTGGGTGAACTTTTTTACCACGCTAGGTTGATCTATTTTAAGACTCTT |
| 682 | Pra_005313_ORF_O1 | AAAATAGCTGCGCGTACCACAAAGGTGACAAACGCCGGATTTCTCTTATCAGACTTGTCA |
| 683 | Pra_006362_O_1 | TTTAATTATCATAGTTTTATTCCGGCTATCTTGATCATTCACGGAAGTCCCGAGAGTCAA |
| 684 | Pra_006493_O_3 | GTGGAGTGAACGTGGTTACTTCAATGGATTACCCTTCTATCGTGTCATTAAACACTTTGT |
| 685 | Pra_006983_O_1 | GCTAACTCTTCTAGTTGAGATCTCCATCAATTAATGGATACAAACATTGAGTTTCACTTT |
| 686 | Pra_007665_O_1 | GGATCACTACTGGATTCCGTTACATTAGTTATTGCAAGTTGGTTATTATGTACGTTTATA |
| 687 | Pra_012196_O_1 | ATGAACAAATGCAATTACCCTGTTTTATTCTATCCCGCTTTAATTAATATTGGTCATGTT |
| 688 | Pra_013382_O_1 | TTTGCTTGTGGATTGTACTGTGGTACATGGTATAAATCTATAGGCTATGTCGATTATTTT |
| 689 | Pra_016461_O_1 | ATATAAGATATAAGATATTGCCAGCAAACTATTTGACAGGTTATTTAATAAAGTGTGCTA |
| 690 | Pra_017611_O_1 | TTTTAAATGTGGACAGAGGCACTATAAGAATGCGAAATATCGTCGGAGCACGACTAATTG |
| 691 | Pra_019776_O_1 | ATAGACTAGTTCTACAAAGCCCTAGGATGATGGACTTCATTTCTTTTGCATTAAGATGAA |
| 692 | Pra_020659_O_1 | GATTTCTTATGGGGTTGGAACATTCCTCGCTGCCTTCTGGTAATATTAGGTTATGCGTTT |
| 693 | Pra_022559_O_3 | AATTGAGGTTGACTGTGTACTTCTCCAGTGGACAGGAGAAAGCGATAAAATTCAAACGTT |
| 694 | Pra_024188_O_5 | AAGGAAGGGCAAATAGAGCTCGCGCTCAAGAAATACCTTAAATCGATACGGTATTTGGAT |
| 695 | Pra_027973_O_2 | TAATTTAAGAGCTATGAAACAACTACCTTTTGGAATGGTTTTGTTTTTAGCATCCCAATT |
| 696 | Pra_001353_O_1 | TTGTAAATTATGCTGGTTCCATATGGGGGTTAATCAGTATCCTGGTTATTTGTGACACCA |
| 697 | Pra_001978_O_3 | GTTGTGAACTATCAATAGACGGGGATGGTCCTTTTTAGCTGCTCCTTAAGCAGCTCAAAT |
| 698 | Pra_002810_O_2 | TCAATTCCGGTCATATGTAGACGACTATAATGTTGTTTGTGTCCTATAACTATAGTGTTG |
| 699 | Pra_002811_O_1 | CATTTTACACCCTATAACAAAATATAGTGTCATAAGTTTACACCAGGTAACAACTCTATA |
| 700 | Pra_002812_O_3 | ATGGAGAGTTTTATTCATTACATGAAAGAGTATGTCACCTTTCGTGCTCCATCTATTGAT |
| 701 | Pra_003514_O_1 | TTTCACGTCCTGTATACTCACTCAAGCAACTTTAGGATGAAGAGCTAAAGTATATCAAAG |
| 702 | Pra_004104_O_2 | AATGCACTCTTTATAAAGTGGGATGAGGTATGTGTTTCCTTCCTATTGGCTAACCTGAAT |
| 703 | Pra_005595_O_1 | ATTGGGCAATCGTTATTGATTTTACCTATCGCTATCTCACTGTCCGCCAATTTAGTGTAA |
| 704 | Pra_005754_O_1 | TTTCAGCGGATATAAAGTCTTCCAACTTGTAAACCGGTGCTGTGAAGATTAAAGTCCTT |
| 705 | Pra_006463_O_1 | GCTTTAGAGGCAATGGTAGATTATGAAGTCAACACCAGGGAGTTTGACCGTTTGGGACAT |
| 706 | Pra_006665_O_1 | CATTCAATTTGACATTGGAGTTTCAAGGCATTCCAAGGATAGCATGTACACAAGTTGAAT |

TABLE 14-continued

Oligo Table.

| Oligo SEQ ID | Oligo ID | Microarray Oligo Seq |
|---|---|---|
| 707 | Pra_006750_O_1 | CATAAAATTACTATGGAAGTTGGATCATTATCTATGCCATAGTGGAGTAGAACTAGATTT |
| 708 | Pra_007030_O_1 | CTCTTGATTCTAGAATCTAAACTACTACCTTGCGGACATGACTGAGCATCTCTCTAACAG |
| 709 | Pra_007854_O_1 | CAGGGTTGTGCTAGTTTAACATTTTAACTTAATGTAATCATGTAAGCTTTAGAGAGGTGG |
| 710 | Pra_007917_O_1 | GTAAATGTTTACATTGAGGTCATGCATGAGTGTTAATTACGCTTTCACTACTGTTCACTT |
| 711 | Pra_007989_ORF_O2 | AATTAAAGCTTGGTTGTATGATCATTTGGGATCGAGAGTAGATTATGATGCTCCTGGGCA |
| 712 | Pra_008506_O_1 | TTATCTAGCTAGAAGTTGTGAAATTAAGAGGGATGTGAGGATTGGGTTATAACTAGTGTA |
| 713 | Pra_008692_ORF_O2 | AATGAATCAGGCATTAAAGCGGGAATCATTTATGACTTGGCAACCTGAAAATTCTATTAA |
| 714 | Pra_008693_O_2 | TTCTTGACGTTTTAATATGGTATGGTATTAAATTTGGAAGGCCTATTCGATTGTTTGCAA |
| 715 | Pra_009170_O_1 | TTCTTATAACCTGTACGATTGCCGATATATCACCAATTTTGCTGATTTTAATCTGAGTTT |
| 716 | Pra_009408_O_1 | CAATTTCATATTCGGGTTCAATGTAGTGCCTCTCATTTTAGGGTGATAGCATGAGTTTTT |
| 717 | Pra_009522_O_1 | TCCACAAGTTAACATAGGTAACTATCGACTGAAGTGAACTGGGGGGCAGAAGCTAACTAT |
| 718 | Pra_009734_O_2 | TTTAGATAGCCATTTACATTTTACTTATTATTGGACTTGTAAAGATTTTTGTACCCTTGT |
| 719 | Pra_009815_O_4 | TTGCTGAAATATTTCAAGCTGAAAGTTATGATTCTGGCCAAGAAGTCTACTGAAAATTTG |
| 720 | Pra_010670_O_2 | AAACATAAGTTTGGCCCAGATTCGGTTTATCATAAAATCTGGCTGCATATAAGGTGTCAG |
| 721 | Pra_011297_O_1 | ATGTTCTAGAATTTGTCTAAGCTAGCTACTGGTGTTTAACTGATATGGAAAACTTTTGCC |
| 722 | Pra_013098_O_2 | TTTGGGGAGTACTTTAGTCAATAAAAGTGAAGTGAATCATGATATAAAGGGTTTAAGTAA |
| 723 | Pra_013172_O_2 | AGAAGTTACTAATTTGTAGATAAATTCTAACGAAGGTGATGATAGCATACACGTAATGAA |
| 724 | Pra_013589_O_2 | GAATTTTGATGGTAGCGTATGGTTGAAGGAAAACTTGGATATATCATGTAAACATTTTTC |
| 725 | Pra_013608_O_1 | TTAATGAACCGCTTTTCCTTGAGAGGCTATGAATGCCTGTAGAACTAATCCTTTAAGTA |
| 726 | Pra_014299_O_2 | TTTCTCTAACACTATATTTTCTGGTATGACCGCTCTACATTGTATATTAACCCTTGCAAA |
| 727 | Pra_014498_O_1 | TATATTCACTGTGCTGGGATTATCCTCTCCCTTTTTGACCCACTGTTGTGTGTATTTGA |
| 728 | Pra_014548_O_1 | GAGCATACAGCGTTATCTTTGAGACGAGTCATCAATGATAATATCCTCGTAAAAGGTTAC |
| 729 | Pra_014610_O_2 | TTTATTCAATTACGACGGATTCAGTTGGCCTTTTGTAACATTCAAGTATCCATCTATCAC |
| 730 | Pra_016090_O_2 | ATGTTCAGGGGTATTAAAAATTCAGAGGATAAATTTCCTCACTCTCAAGTGTTAGATGGT |
| 731 | Pra_016722_O_2 | CAAAGTCTAGACGTTAATGTTTTGGAACTCTTTTTTCGAATTTGTGCCTATTGAATCACT |
| 732 | Pra_016785_O_3 | TATAAATATATTGTACTGGGGATCCAAGACATGGCAATATATGTCGAGATTTTCATTTTC |
| 733 | Pra_017094_O_3 | CTTTTGCATGAGTTCAAATGTCTTTGTGACATATTGTCTTGAACCACCGAGGATATATCA |
| 734 | Pra_017527_O_2 | GTTTGTATGTCCAATAGATTATAACCTATTTACTGTGACACTATTCTTCACACCCATGTC |
| 735 | Pra_017591_ORF_O2 | AGATCTAGTTGTTTCAGCATCGTTGGACCAAACTGTTCGTGTATGGGATATAAGTGGCCT |
| 736 | Pra_017769_O_2 | TGCCGTATCAAAAGATTGGTACTTCCTTATGGACACACAAGATCGTAAGCATGGCTGAAT |
| 737 | Pra_018047_O_2 | TTGATGGCCACATGAGTTGTTTATACAAGTCGTTGTTTTATGAGAGAACCTTCTTCAGAT |
| 738 | Pra_018414_O_1 | ATTTCTATAGTGCCATATGCTTGTCGGTTGTCATTGACCTCTAATAGAATAGCCAGAGTA |
| 739 | Pra_018986_O_1 | TTCACGGCAGTTGAACTAGTCATAGTGGAATATTATTTAAATGGTGTATTCTAGTCACAT |
| 740 | Pra_019479_ORF_O1 | TGCAGGCGCTCTATAGTTCTGTTCTCTAGCATGAAGTGTGTATTTTATCTATTGTGGACC |
| 741 | Pra_020144_O_1 | TGTCTTTAATCTTCAGGGTTCGTTACTAACAATTGAGCTCAAATCTCTATTCTGACCAGC |
| 742 | Pra_022480_O_1 | CATTTATAGAGTTGTGCAAAATCACCCATAATGCTATGAATTGACAGGTGACTGTAATCT |
| 743 | Pra_023079_O_2 | GGAGAAAATTTCCTATCCCTTTGTGGGTGTGTGAAAAACGAAATATAGAGGAACAATGTG |

TABLE 14-continued

Oligo Table.

| Oligo SEQ ID | Oligo ID | Microarray Oligo Seq |
|---|---|---|
| 744 | Pra_026739_O_2 | ACCAATCATTTATTTGCAGTGTAGTTGATATGAAGGGAGAAATATGACAGTTGGTTTCAA |
| 745 | Pra_026951_O_2 | AAGTTAATGTTCTCATAGGTTATTCATTGGAGTTGTCTCGTATGTACGCTGTGCCGTAGT |
| 746 | Pra_026529_O_2 | CTCATAAATTGAGGCTTGCCTACGTTAATTGTTATATATGGAGAGCCATGCTAATTGTTA |
| 747 | Euc_006366_O_2 | GCAGATCATGTAATTGTATCTCAAATTATAGTATCCGTATTCTGTACAAATGCTCCGGAA |
| 748 | Euc_017378_O_1 | TCTTTACGCAGATGGTGACTGAAGCTGGTTCCGAGATCGGCATATGTAGCTGGTAGAGGT |
| 749 | Pra_000888_O_1 | TTCACATTGAGGGTTGCCGTCGGTATTCGCCGATGATATCCTGTTTTACGCGCAACAGTT |
| 750 | Pra_014166_O_1 | TCATTATTTAGGGTGCAGGCTGTATAAAATGTTGTAAATTGTAGTATCAATGTGTACAAT |
| 751 | Pra_003189_O_1 | GCATTCACCACGACAGTAAAGTAATCATTATGATTACTAATGTATTGCTTTCATGGGGTG |
| 752 | Pra_009356_O_4 | AAAGGGTATATTTTGTCTCATGTTGGGGTGATAATTCTCCCTGAAAGTCTCCAAAATATA |
| 753 | Pra_000065_ORF_O_2 | AAATTTCCGGTTGCCATAGTCTAGTGGGGTGAGGGTTCATTCTAGGGGATTTATTGTGTT |
| 754 | Pra_014197_ORF_O1 | GCAGTGATAAAGGTACTTCTTGGTGATAATCCTAAAGCCTTACCCATGGATATCCAGCCT |
| 755 | Pra_009081_O_2 | TTCTTTAACAAGGTAAAAATCCCCCCCTTGGCATGTAGCTCAATTAGTTGTAATGGAACT |
| 756 | Pra_013417_O_1 | AGTTGTAAACAGTGTAATAAGGAGCAGAAGTTGTGATAGCTTTTAGGAACGATAGACTTT |
| 757 | Pra_005755_O_1 | TGAACCAATTCTTGTATATTAGATATGTAACATGTATGAATGTCCATAGAGCAGAGCTTT |
| 758 | Pra_006670_O_2 | AGCCAGGCACGCTTAACTAAATTTCGTTTAGTTCACCATGACTATTCGTTGAACTTAATG |
| 759 | Pra_007027_O_1 | CAAAACCCCTTGTAGGGTGGACTTCTGTTGTATCCAATTTTTATGGCATAATTAGCTAGT |
| 760 | Pra_007276_O_1 | AATTTGGTGATTATTCCTTACCATATCGTACTGTACAGATACGGTAAGGTCGAAATATAT |
| 761 | Pra_007390_ORF_O1 | CATGCCGTGATCGGTCGATTGCATTAAGTGCTGCAAGGATCAAATAGTGGCACTGTCATG |
| 762 | Pra_012648_ORF_O1 | CAAACATAAATAAGGTTGCTACTTTAAAGGGACATACGGAACGAGTTACTGATGTGGCAT |
| 763 | Pra_013171_O_2 | ATTTATGGATGAGGTACTCCTTATGAATATCTTCAAACTAAGAAATAACTATATATGCAA |
| 764 | Euc_045414_O_2 | CTTGGTTTTTGTTGAGCTTTCTATTTCAAGCAATTTGTGATTGGGGGTTCTGCATTCTT |
| 765 | Euc_044328_O_2 | ATGTCTAAAGAGCCGTGATCTATGAGTAGATTAGAAACCGCCTTTTTAGTTGCAAACGCC |
| 766 | Euc_015615_O_2 | TTGCAACAAGGTATACTTAGTCAGTCCTTGTTATGTATGTCTTTTGTCAACCCTTCAGGG |
| 767 | Euc_017239_O_3 | GGCGGAATCCCTTTGTTCTTTCGAGCTTTACGTGACAAGTCGGCCAGAAAGCAGTAGCAT |
| 768 | Euc_018643_O_3 | TTGATGTACGAGCCGCTATATCTAATTCTGCCTCCCAGTCACTGCCAAGTTTTACTCTTC |
| 769 | Euc_019127_O_5 | GTCTTGCATGTCAGCTATTATACAGTCCTGTTTATAGTCCTGTGATGTAATAAAAAGCTG |
| 770 | Euc_022624_O_3 | AAGTAGGAGATCGTGTAGAGAGAATACTTTCTGCTCTCAGCGGCGAAGAGGTTTGTCTGC |
| 771 | Euc_032424_O_1 | AATTGTGAGTAGAATAGGAGAAACTTTTGTACAAGATTAATACGTGTGGCATAATAAGAT |
| 772 | Euc_037472_O_1 | TGATGTGCAGTTTACATTATTATGGTTCGAGTATTATTTAGCTGCCCTATCTTAAGTCAT |

TABLE 15

Peptide Table.

| Protein SEQ ID | Target | Patent PEPTIDE Sequence | Patent ORF start | Patent ORF stop |
|---|---|---|---|---|
| 261 | CDK type A | MGDSLGSSGGRGNSGGGGGGGSRPEWLQQYDLIGKIGEGTYGLVFLARIKHPST NRGKYIAIRKFKQSKDGDGVSPTAIREIMLLREISHENVVKLVNVHINPVDMSL YLAFDYADHDLYEIIRHHRDKVNQAINPYTVKSLLWQLLNGLNYLHSNWIIHRD LKPSNILVMGEGEEQGVVKIADFGLARVYQAPLKPLSDNGVVVTIWYRAPELLL GAKHYTSAVQMWAVGCIFAELLTLKPLFQGQEVKANPNPFQLDQLDKIFKVLGH | 387 | 1820 |

TABLE 15-continued

Peptide Table.

| Protein SEQ ID | Target | Patent PEPTIDE Sequence | Patent ORF start | Patent ORF stop |
|---|---|---|---|---|
| | | PTQEKWPMLVNLPHWQSDVQHIQRHKYDDNALGHVVRLSSKNATFDLLSKMLEY DPQKRITAAQALEHEYFRMEPLPGRNALVPSSPGDKVNYPTRPVDTTTDIEGTT SLQPSQSASSGNAVPGNMPGPHVVTNRPMRPMHMVGMQRVPASGMAGYNLNPS GMGGGMNPSGIPMQRGVANQAQQSRRKDPGMGMGGYPPQQKQRRF | | |
| 262 | CDK type A | MEKYQQLAKIGEGTYGIVYKAKDKKSGELLALKKIRLEAEDEGIPSTAIREISL LKQLQHPHIVRLYDVVHTEKKLTLVFEFLDQOLKKYLDACGDNGLEPYTVKSFL YQLLQGIAFCHEHRVLHRDLKPQNLLINMEGELKLADFGLARAFGIPVRNYTHE VVTLWYRAPDVLMGSRKYSTQVDIWSVGCIFAEMVNGRPLFPGSSEQDQLLRIF KTLGTPSLKTWPGMAELPDFKDNFPKYVVQSFKKICPKKLDKTGLDLLSRMLQY DPAKRISAEQAMGHPYFKDLKLRKPKAAGPGP | 99 | 1007 |
| 263 | CDK type A | MDQYEKIEKIGEGTYGVVYKAIDRSTNKTIALKKIRLEQEDEGVPSTAIREISL LKEMQHGNIVKLQDVVHSERRLYLVFEYLDLDLKKHMDSCPEFSKDTHTIKMFL YQILRGISYCHSHRVLHRDLKPQNLLLDRRTNSLKLADFGLARAFGIPVRTFTH EVVTLWYRAPEILLGSRHYSTPVDVWSVGCIFAEMVNRRPLFPGDSEIDELFKI FRIMGTPNEDSWPGVTSLPDFKSTFPKWASQDLKTVTPTVDPAGIDLLSKMLCM DPRRRITAKVALEHEYFKDVGVIP | 120 | 1004 |
| 264 | CDK type A | MVMKSKLDKYEKLEKLGEGTYGVVYKAQDKTTKEIYALKKIRLESEDEGIPSTA IREIALLKELQHPNVVRIHDVIHTNKKLILVFEFVDYDLKKFLHNFDKGIDPKI VKSLLYQLVRGVAHCHQQKVLHRDLKPQNLLVSQEGILKLGDFGLARAFGIPVK NYTNEVVTLWYRAPDILLGSKNYSTSVDIWSIGCIFVEMLNQKPLFPGSSEQDQ LKKIFKIMGTPDATKWPGIAELPDWKPENFEKYPGEPLNKVCPKMDPDGLDLLD KMLKCNPSERIAAKNAMSHPYFKDIPDNLKKLYN | 23 | 937 |
| 265 | CDK type A | MDQYEKVEKIGEGTYGVVYKAIDRLTNETIALKKIRLEQEDEGVPSTAIREISL LKEMQHGNIVRLQDVVHSENRLYLVFEYLDLDLKKHMDSSPDFAKDPRLVKIFL YQILRGIAYCHSHRVLHRDLKPQNLLIDRRTNALKLADFGLARAFGIPVRTFTH EVVTLWYRAPEILLGSRHYSTPVDVWSVGCIFAEMVNQRPLFPGDSEIDELFKI FRILGTPNEDTWPGVTALPDFKSAFPKWPAKNLQOMVPGLNSAGIDLLSKMLCL DPSKRITARSALEHEYFKDIGFVP | 149 | 1003 |
| 266 | CDK type B-1 | MEKYEKLEKVGEGTYGKVYKAKDKATGQLVALKKTRLEMDEEGVPPTALREVSL LQLLSQSLYVVRLLSVEHVDGGSKRKPMLYLVFEYLDTDLKKFIDSHRKGPNPR PVPAATVQNFLYQLLKGVAHCHSHGVLHRDLKPQNLLVDKEKGILKIADLGLGR AFTVPLKSYTHEVVTLWYRAPEVLLGSAHYSIGVDMWSVGCIFAEMVRRQALFP GDSEFQQLLHIFRLLGTPTEKQWPGVTTLRDWHVYPQWEPQNLARAVPSLGPDG VDLLSKMLKYDPAERISAKAALDHPFFDSLDKSQF | 199 | 1116 |
| 267 | CDK type B-2 | MERPATAAVSAMEAFEKLEKVGEGTYGKVYRAREKATGKIVALKKTRLHEDEEG VPPTTLREISILRMLSRDPHIVRLMDVKQGQNKEGKTVLYLVFEYMETDLKKYI RGFRSSGESIPVNIVKSLMYQLCKGVAFCHGHGVLHRDLKPHNLLMDKKTLTLK IADLGLARAFTVPIKKYTHEILTLWYRAPEVLLGATHYSTAVDMWSVGCIFAEL VTKQALFPGDSELQQLLHIFRLLGTPNEKMWPGVSSLMNWHEYPQWKPQSLSTA VPNLDKDGLDLLSQMLHYEPSRRISAKAAMEHPYFDDVNKTCL | 41 | 982 |
| 268 | CDK type C | MGCVLGREVSSGIVTESKGRDSSEVETSKRDDSVAAKVEGEGKAEEVRTEETQK KEKVEDDQQSREQRRRSKPSTKLGNLPKHIRGEQVAAGWPSWLSDICGEALNGW IPRRANTFEKIDKIGQGTYSNVYKAKDLLTGKIVALKKVRFDNLEPESVRFMAR EILILRHLDHPNVVKLEGLVTSRMSCSLYLVFEYMEHDLAGLAASPAIKFTEPQ VKCYMHQLLSGLEHCHNRRVLHRDIKGSNLLLDNGGVLKIGDFGLASPYDPDHK HRMTSRVVTLWYRPPELLLGANDYGVGIDLWSAGCILAELLAGKPIMPGRTEVE QLHKIYKLCGSPSEEYWKKYKLPNATLFKPREPYRRCIRETFKDFPPSSLPLIE TLLAIDPAERGTATDALQSEFFRTEPYACEPSSLPQYPPSRKMDAKKRDDEARR LRAASKGQADGSKKERTRDRRVRAVPAPEANAELQHNIDREKLISHANAKSKSE KFPPPHQDGALGFPLGASHRFDPAVVPPDVPFTSTSFTSSKEHDQTWSGPLVDP PGAPRRKKHSAGGQRESSKLSMGTNKGRRADSHLKAYESKSIA | 291 | 2042 |
| 269 | CDK type C | MYSKSSAVDDSRESPKDRVSSSRRLSEVKTSRLDSSRRENGFRARDKVGDVSVM LIDKKVNGSARFCDDQIEKKSDRLQKQRRERAEAAAADHPGAGRVPKAVEGEQ VAAGWPVWLSAVAGEAIKGWLPRRADTFEKLDKIGQGTYSSVYKARDVTNNKIV ALKRVRFDNLDTESVKFMAREIHILRMLDHPNVIKLEGLITSRMSCSLYLVFEY MEHDLTGLASRPDVKFSEPQIKCYMKQLLSGLDHCHKHGVLHRDIKGSNLLIDN NGILKIADFGLASVFDPHQTAPLTSRVVTLWYRPPELLLGASRYGVEVDLWSTG CILGELYTGKPILPGKTEVEQLHKIFKLCGSPDDYWRRLHLPHAAVFKPPQPY RRCVAEIFKELPPVALGLLETLISVDPSQRGTAAFALRSEFFTASPLPCDPSSL PKYPPSKEIDMKLREEEARRRGAAGGKNELEKRGTKDSRTNSAYYPNAGGLQVK QCHSNANGRSEIFGPYQEKTVSGFLVAPPKQARVSKETRKDYAEQPDRASFSGP LVPGPGFSKAGKELGHSITVSRNTNLSTLSSLVTSRTGDNKQKSGPLVSESANQ ASRYSGPIREMEPARKQDRRSHVRTNIDYRSREDGNSSTKEPALYGRGSAGNKI YVSGPLLVSSNNVDQMLKEHDRRIQEHARRARFDKARVGNNHPQAAVDSKLVSV HDAG | 107 | 2236 |

TABLE 15-continued

Peptide Table.

| Protein SEQ ID | Target | Patent PEPTIDE Sequence | Patent ORF start | Patent ORF stop |
|---|---|---|---|---|
| 270 | CDK type C | MGCIPTIISDGRRRSAAPDKRRPRPRRSSSEGEAPPHATAAGSEGGESARGAPG KERPEPAPRFVVRSPQGWPPWLVAAVGHAIGEFVPRCADSFRKLAKIGEGTYSN VYKARDLVTGKTVALKKVRFDNLEAESIKFMAREILVLTRLNHPNVIKLEGPVT SRMSSGLYLAFEYMEHDLSGIAARQNGKFTEPQVKCFMRQLLSGLEHCHNHDVL HRDIKCSNLLIDNEGNLKIADFGLATFYDPERKQVMTNRVVTLWYRAPELLLGA TSYGIGIDLWSAGCILAELLYGKPIMPGRTEVEQLHKIFRLCGSPSEAYWNKFK LPNANIFKPPQPYARCIAETFKDFPPSALPLLETLLSIDPDERGTATTALNSEF FAAEPHACEPSSLPKYPPSKEMDLKLIKEKTRRDSSKRPSAIHGSRRDGIHDRA GRVIPAPEATAENQATLHRPRAMKKANPMSRSEKFPPAHNDGVVGSSANAWLSG PASNAAPDSRRHRSLNQNPSSSVGKASTGSSTTQETLKVAPELLQVGSSSLHPC HRMLVYGSNLTIRSK | 82 | 1749 |
| 271 | CDK type C | MGCICAKQADRGPASPGSGILTGAGTGTGTRSSKIPSGLFEFEKSGVKEHGGRS GELRKLEEKGSLSKRLRLELGFSHRYVEAEQAAAGWPSWLTAVAGDAIQGGLVPL KADSFEKLEKIGQGTYSSVFRARELANGRMVALKKVRFDNFQPESIQFMAREIS ILRRLDHPNIMKLEGIITSRMSNSIYLVFEYMEHDLYGLISSPQVKFSDAQVKC YMKQLLSGIEHCHQHGVIHRDVKSSNILVNNEGILRIGDFGLANILNPKDRQQL TSHVVTLWYRPPELLMGSTSYGVTVDLWSVGCVFAELMFRKPILRGRTEVEQLH KIFKLCGSPPDGYWKMCKVPQATMFRPRHAYECTLRERCKGIATSAMKLMETFL SIEPHKRGTASSALISEYFRTVPYACDPSSLPKYPPNKEIDAKHREEARRKKAR SRVREAEVGKRPTRIHRASQEQGFSSNIAPKEKRSYA | 151 | 1560 |
| 272 | CDK type C | MAVAAPGHLNVNESPSWGSRSVDCFEKLEQIGEGTYGQVYMAKEKKTGEIVALK KIRMDNEREGFPITAIREIKILKKLHHENVIKLKEIVTSPGPEKDEQGRPEGNK YKGGIYMVFEYMDHDLTGLADRPGMRFSVPQIKCYMRQLLTGLHYCHINQVLHR DIKGSNLLIDNEGNLKLADFGLARSFSNDHNANLTNRVITLWYRPPELLLGATK YGPAVDMWSVGCIFAELLHGKPIFPGKDEPEQLNKIFELCGAPDEINWPGVSKI PWYNNFKPTRPMKRRLREVFRHFDRHALELLERMLTLDPSQRISAKDALDAEYF WADPLPCDPKSLPKYESSHEFQTKKKRQQQRQHEETAKRQKLQHPPQHPRLPPV QQSGQAHAQMRPGPNQLMHGSQPPVATGPPGHHYGKPRGPSGGAGRYPSSGNPG GGYNHPSRGGQGGSGGYNSGPYPPQGRAPPYGSSGMPGAGPRGGGGNNYGVGPS NYPQGGGGPYGGSGAGRGSNMMGGNRNQQYGWQQ | 82 | 1644 |
| 273 | CDK type C | MGCICTKGILPAHYRIKDGGLKLSKSSKRSVGSLRRDELAVSANGGGNDAADRL ISSPHEVENEVEDRKNVDFNEKLSKSLQRRATMDVASGGHTQAQLKVGKVGGFP LGERGAQVVAGWPSWLTAVAGEAINGWVPRRADSFEKLEKIGQGTYSSVYRARD LETNTIVALKKVRFANMDPESVRFMAREIIIMRKLDHPNVMKLEGLITSRVSGS LYLVFEYMDHDLAGLAATPSIKLTESQIKCYMQQLLRGLEYCHSHGVLHRDIKG SNLLVDNNGNLKIGDFGLATFFRTNQKQPLTSRVVTLWYRPPELLLGSSDYGAS VDLWSSGCILAELFAGKPIMPGRTEVEQLHKIFKLCGSPSEEYWKKSKLPHATI FKPQQPYKRCLLETFKDFPSSALGLLDVLLAVEPECRGTASSALQNEFFTSNPL PSDPSSLPEYPSSEEFDARLRDEEAREHEATAGEARGLESIREGSEESEVVPTS NANADLEASIQEREQSNPRSTGEEPGGTTQNNFILSGQSAEPSLNGSTQIGNA NSVEALIVPDRELDSPRGGAELRRQRSFNQRRASQLSRFSNSVAVGGDSHLDCS REEGANTQWRDEGFVARCSHPDGGELAGKHDWSHHLLHRPISLFEEGGEHSRRD SIASYSPEKGRIHYSGPLLPSGDNLDEMLEEHERQIQNAVREARLDEVETEREY ADHGQTESLLCWANGR | 626 | 2782 |
| 274 | CDK type D | MDPDPSPDPDPPESWSIHTRREIIARYEILERVGSGAYSDVYRGRRLSDGLAVA LEEVHDYQSAFREIEALQILRGSPHVVLLHEYFWREDEDAVLVLEFLRSDLAAV IADASRRPRDGGGGGAAALRAGEVERWMLQVLEGVDACHRNSIVHRDLEPGNLL ISEEGVLEIADFGQARILLDDGNVAPDYEPESFEERSSEQADILQQPETMEADT TCPEGGQEQGAITREAYLREVDEFEAENPRHEIDEETSIFDGDTSCLATCTTSDI GEDPFKGSYVYGAEEAGEDAQGCLTSCVGTRWFRAPELLYGSTDYGLEVDLWSL GCIFAELLTLEPLFPGISDIDQLSRIFNVLGNLSEEVWPGCTELPDYRTISFCE IENPIGLESCLPNCSSDEVSLVRRLLCYDPAARATPMELLQDEYFTEEPLPVPI SALQVPQSENSHDEDSAGGWYDYNDMDSDSDFEDFGPLEFTPTSTGFSIQFP | 13 | 1467 |
| 275 | CDK type D | MDPDPSPSPDPPKSWSIHTRREIIARYEILERVGSGAYSDVYRGRRLSDGLAVA LKEVHDYQSAFREIEALQILRGSPHVVLLHEYFWREDEDAVLVLEFLRSDLAAV IADASRRPRGGGVAPLRAGEGKRWMLQVLEGVDACHRNSIVHRDLKPGNLLISE EGVLKIADFGQARILLDDGNVAPDYEPESEEERSSEQADILQQPETMEADTTCP EGQEQGAITREAYLREVDEFKAKNPRHEIDKETSIYDGDTSCLATCTTSDIGED PFKGSYVYGAEEEAGEDAQGSLTSCVGTRWFRAPELLYGSTDYGLEVDLWSLGCI FAELLTLEPLFPGISDIDQLSRIFNVLGNLSEEVWPGCTKLPDYRTISFCKIEN PIGLESCLPNCSSDEVSLVRRLLCYDPAARATPMELLQDKYFTEEPLPVPISAL QVPQSKNSNDEDSAGGWYDYNDMDSDSDFEDFGPLKFTPTSTGFSIQFP | 113 | 1558 |
| 276 | Cyclin A | MSNQHRRSSFSSSTTSSLAKRHASSSSSSLENAGKAFAAAAVPSHLAKKRAPLG NLTNLKAGDGNSRSSSAPSTLVANATKLAKTRKGSSTSSSIMGLSGSALPRYAS TKPSGVLPSVNPSIPRIEIAVDPMSCSMVVSPSRSDMQSVSLDESMSTCESFKS PDVEYIDNEDVSAVDSIDRKTFSNLYISDAAAKTAVNICERDVLMEMETDEKIV NVDDNYSDPQLCATIACDIYQHLRASEAKKRPSTDFMDRVQKDITASMRAILID | 187 | 1686 |

TABLE 15-continued

Peptide Table.

| Protein SEQ ID | Target | Patent PEPTIDE Sequence | Patent ORF start | Patent ORF stop |
|---|---|---|---|---|
| | | WLVEVAEEYRLVPDTLYLTVNYIDRYLSGNVMNRQRLQLLGVACMMIAAKYEEI CAPQVEEFCYITDNTYFKEEVLQMESSVLNYLKFEMTAPTVKCFLRRFVRAAQG VNEVPSLQLECMANYIAELSLLEYDMLCYAPSLVAASAIFLAKFVITPSKRPWD PTLQHYTLYQPSDLGNCVKDLHRLCFNNHGSTLPAIREKYSQHKYKYVAKKYCP PSIPPEFFHNLVY | | |
| 277 | Cyclin A | MNKENAVGTKSEAPTIRITRSRSKALGTSTGMLPSSRPSFKQEQKRTVRANAKR SASDENKGTMVGNASKQHKKRTVLNDVTNIFCENSYSNCLNAAKAQTSRQGRKW SMKKDRDVHQSGAVQIMQEDVQAQFVEESSKIKVAESMEITIPDKWAKRENSEH SISMKDTVAESSRKPQEFICGEKSAALVQPSIVDIDSKLEDPQACTPYALDIYN YKRSTELERRPSTIYMETLQKDVTPNMRGILVDWLVEVSEEYKLVPDTLYLTVN LIDRSLSQKFIEKQRLQLLGVTCMLIASKYEEICPPRVEEFCITDNTYTSLEV LKMESRVLNLLHFQLSVPTVKTFLRRFVQAAQVSSEVPSVELEYLANYLAELTL VEYSFLKFLPSLMAASAVLLARWTLNQSDNPWNLTLEHYTKYKASELKAAVLAL EDLQLNTSGSTLNAIREKYRQQKVNYSLLIHSKANHEIL | 238 | 1653 |
| 278 | Cyclin B | MAGSDENNPGVVGGAHVQEGLRVGAGKMGAGNVQQRRALSNINSNIIGAPPYPC AVNKRVLSEKNVNSENDLLNAAHRPITRQFAAQMAYKQQLRPEENKRTTQSVSN PSKSEDCAILDVDDDKMADDFPVPMFVQHTEAMLEEIDRMEEVEMEDVAEEPVT DIDSGDKENQLAVVEYIDDLYMFYQKAEASSCVPPNYMDRQQDINERMRGILID WLIEVHYKFELMDETLYLTVNLIDRFLAVQPVVKKKLQLVGVTAMLLACKYEEV SVPVVEDLILISDRAYSRKEVLEMERLMVNTLHFNMSVPTPYVFMRRFLKAAQS DKKLELLSFFIIELSLVEYDMLKFPPSLLAASAIYTALSTITRTKQWSTTCEWH TSYSEEQLLECARLMVTFHQRAGSGKLTGVHRKYSTSKFGHAARTEPANFLLDF RL | 235 | 1539 |
| 279 | Cyclin B | MASRPIVPVQARGEAAIGGGAGKAAIGGGAGKQQKKNGAAEGRNRKALGDIGNL VTVRGIEGKVQPHRPITRSFCAQLLANAQAAAAAENNKKQAVVNVNGAPSILDV PGAGKRAEPAAAAAAAVAKAAQKKVVKPKQKAEVIDLTSDSERAIEAKKKQQHH EPTKKEGEKSSRRNMPTLTSVLTARSKAACGMTKKPKEKVVDIDAGDAHNELAA FEYIEDIYTYYKEAENESLPRNYMSSQPEINEKMRAILVDWLIEIHNKFDLMPE TLYLTINIIDRFLSVKAVPRRELQLLGMGALFTASKYEEIWAPEVNDLVCIADR AYSHEQVLAMEKTILGKLEWTLTVPTHYVFLVRFIKASLGDRKLENMVYFLAEL GVMNYATLTYCPSMVAASAVYAARCTLGLTPLWNDTLKLHTGFSESQLMDCARL LVGYHAKAKENKLQVVYKKYSSSQREGVALIPPAKALLCEGGGLSSSSSLASSS | 158 | 1618 |
| 280 | Cyclin B | MGLPDENNAALSKPTNLQVGGLEIGGRKFGQEIRQTRRALSVINQNLVGDRAYP CHVVNKRGHSKRDAVCGKDQVDPVHRPLTRKFAAQTASTQQHCIEEAKKPRTAV QERNEFGDCIFVDVEDCQPSSENQPVPMFLEIPESRLDDDMEEVEMEDIVEEEE EEPIMDIDGRDKKNPLAVVDYIEDIYANYRRTENCSCVSANYMAQQAOINEKMR SILIDWLIEVHDKFDLMHETLFLTVNLIDRFLARQSVVRKKLQLVGLVAMLLAC KYEEVSVPVVGDLILISDKAYTRKEVLEMESLMLNSLQFNMSVPTPYVFMRRFL KAAESDKKLEVLSFFLIELSLVEYEMVKFPPSLLAAAAIFTAQCTLYGFKQWTK TCEWHSNYTEDQLLECARMMVGFHQKAATGKLTGVHRKYGTSKFGYTSKCEPAN FLLGEMKNP | 205 | 1530 |
| 281 | Cyclin B | MGLPDENNAALSKPTNLQVGGLEIGGRKFGQEIRQTRRALSVINQNLVGDRAYP CHVVNKRGHSKRDAVCGKDQVDPVHRPLTRKFAAQTASTQQHCIEEAKKPRTAV QERNEFGDCIFVDVEDCQPSSENQPVPMFLEIPESRLDDDMEEVEMEDIVEEEE EEPIMDIDGRDKKNPLAVVDYIEDIYANYRRTENCSCVSANYMAQQADINEKMR SILIDWLIEVHDKFDLMHETLFLTVNLIDRFLARQSVVRKKLQLVGLVAMLLAC KYEEVSVPVVGDLILISDKAYTRKEVLEMEKLMLNSLQFNMSVPTPYVFMRRFL KAAESDKKLEVLSFFLIELSLVEYEMVKFPPSLLAAAAIFTAQCTLYGFKQWTK TCEWHSNYTEDQLLECARMMVGFHQKAATGKLTGVHRKYGTSKFGYTSKCEAAN FLLGEMKNP | 174 | 1499 |
| 282 | Cyclin D | MAMVQRQGHDPSSPQEQEDGPSSFLSDDALYCEEGRFEEDDGGGGGQVDGIPLF PSQPADRQQDSPWADEDGEEKEEEEAELQSLFSKERGARPELAKDDGGAVAARR EAVEWMLMVRGVYGFSALTAVLAVDYLDRFLAGFRLQRDNRPWMTQLVAVACLA LAAKVEETDVPLLVELQEVGDARYVFEAKTVQRMELLVLSTLGWEMHPVTPLSF VHHVARRLGASPHHGEFTHWAFLRRCERLLVAAVSDARSLKHLPSVLAAAAMLR VIEEVEPFRSSEYKAQLLSALHMSQEMVEDCCRFILGIAETAGDAVTSSLDSFL KRKRRCGHLSPRSPSGVIDASFSCDDESNDSWATDPPSDPDDNDDLNPLPKKSR SSSPSSSPSSVPDKVLDLPFMNRIFEGIVNGSPI | 94 | 1332 |
| 283 | Cyclin D | MEASYQPHHHGHLRQHDPSSSQQEEQVPFDALYCSEEHWGEEDEEEGLASDGLL SEERDHRLLSPRALLDQDLLWEDEELASLFSKEEPGGMRLNLENDPSLADARRE AVEWIMRVHAHYAFSALTALLAVNYWDRFTCSFALQEDKPWMTQLSAVACLSLA AKVEETQVPLLIDFQVEDSSPVFEAKNIQRMELLVLSSLEWKMNPVTPLSFLDY MTRRLGLTGHLCWEFLRRCEMVLLSVISDCRFTCYLPSVIAASTMLHVINGLKP RLDVEDQTQLLGILAMGMDKIDACYKLIDDDHALRSQRYSHNKRKFGSVPGSPR GVMELCFSSDGSNDSWSVAASVSSSPEPHSKKSRAGEEAEDRLLRGLEGEEDDP ASADIFSFPH | 176 | 1342 |

TABLE 15-continued

Peptide Table.

| Protein SEQ ID | Target | Patent PEPTIDE Sequence | Patent ORF start | Patent ORF stop |
|---|---|---|---|---|
| 284 | Cyclin D | MALQEEDTRRHYPTAPPFSPDGLYCEDETFGEDLADNACEYAGGGARDGLCEIK DPTLPPSLLGQDLFWEDGELASLVSRETGTHPCWDELISDGSVALARKDAVGWI LRVHGHYGFRPLTAMLAVNYLDRFFLSRSYQRDRPWISQLVAVACLSVAAKVEE TQVPILLDLQVANAKFVFESRTIQRMSLLLMSTLDWRMNSVTPISFFDHILRRF GLTTNLHRQFFWMCERLLLSVVADVRLASFLPSVVATAAMLYVNKEIEPCICSE FLDQLLSLLKINEDRVNECYELILELSIDHPEILNYKHKRKRGSVPSSPSGVID TSFSCDSSNDSWGVASSVSSSLEPRFKRSRFQDQQMGLPSVNVSSMGVLNSSY | 150 | 1283 |
| 285 | Cyclin-dependent kinase regulatory subunit | MGQIQYSEKYFDDTYEYRHVVLPPDVAKLLPKNRLLSENEWRAIGVQQSRGWVH YAIHRPEPHIMLFRRPLNYQQQQENQAQQNMLAK | 101 | 367 |
| 286 | Histone acetyltransferase | MGSIDPPKAEQNGTAAAAVADPGQKPGAGDAMPPPPPVKHSNGTAAEPDVATKR RRMSVLPLEVGTRVMCRWRDGKYHPVKVIERRKLNPGDPNDYEYYVHYTEFNRR LDEWVKLEQLDLNSVETVVDEKVEDKVTGLKMTRHQRRKIDETHVEGHEELDAA SLREHEEFTKVKNIATIELGRYEIETWYFSPFPPEYNDCSKLYFCEFCLNFMKR KEQLQRHMKKCDLKHPPGDEIYRSGTLSMFEVDGKKNKVYGQNLCYLAKLFLDH KTLYYDVDLFLFYVLCECDDRGCHMVGYFSKEKHSEESYNLACILTLPPYQRKG YGKFLIAFSYELSKKEGKVGTPERPLSDLGLLSYKGYWTRVLLDILKKHKANIS IKELSDMTAIKADDILNTLQSLDLIQYRKGQHVICADPKVLDRHLKAAGRGGLE VDVSKLIWTPYREQG | 9 | 1352 |
| 287 | Histone acetyltransferase | MAQKHSTAPDPAAEFKKRRRVGFSGIDAGVDPNGCFKVYLVSREEEVGAPDSFQ LDPVDLSHFFEEEDGKIYGEGLKISVWVSCVSFHSYAEIAFESKSDGGKGITD LWTALKNMFGETLVDNKDDFLQTFSKETQFIRSTVSAGEILKHKHSDDHVNDSV SNLKVGSDVEAVRMIJMGDMTAGHLYSRLVPLVLLLVDGSSPIDVTDSSWELYLL IQKTSDQQGNFHDRLLGFAAVYRFYHYPDSSRRLGQILVLPLYQRKGYGRYLL EVLNWVAIADDVYDFTIEEPVDNLQHLRTCIDVQRLLSFDKVQQAVNSTVSQLK QGKLSKKTYIPRLLPPPSVVEDARKRFKINKKQFLQCWEILVYLGLDPADKSIQ DYFSVISNRVRADILGKDSETAGKKVIEVPSDFDPEMSFVMHRAKAGGEANGIQ VEDNQNKQEEQLQQLIDERLKDIKLIAEKVTQK | 89 | 1486 |
| 288 | Histone acetyltransferase | MAQKHSTAPDPAAEPKKRRRVGFSGIDAGVDPNGCFKVYLVSREEEVGAPDSFC LDPVDLSHFFEEEDGKIYGEGLKISVWVSCVSFHSYAEIAFESKSDGGKGITD LHTALKNMFGETLVDNKDDFLQTFSKETQFIRSTVSAGEILKHKHSDGHVNDSV SHLKVGSDVEAVRMLMGDDTAGHLYSRLVPLVLLLVDGSNPIDVTDSSWELYLL IQKTSDQQGNFHDRLLGFAAVYRFYHYFDSLRLRGQILVLPLYQRKGYGHYLL EVLHNVAIADDVYDFTIEEPVDNLQHLRTCIDVQRLLSFDKVQQAVNSTVSQLK QGKLSKKTYIPRLLPPPSVVEDARKRFKINKKQFLQCWEILVYLGLDPADKSIQ DYFSVISNRVRADILGKDSETAGKKVIEVPSDFDPEMSFVLHRAKAGGETNGIQ VEDNQNKQEEQLQQLIDERLKDIKLIAQKVSRK | 80 | 1477 |
| 289 | Histone deacetylase | MALPMEFWGVEVKAGQPLKVNPGNAKILHLSQASLGECKSSKGNESVPLHVKFG DQKLVLGTLSTENFPQLAFDLVFEKEFELSHNWKSGSVYFCGYKSVVEQDQDEF SDLESDSEEEDLPMIGVENGKVAAQASAKTATASANASKVESSGKQKAKIPQPN KVDEDDSDEDDDDEDEDESDEEGVDGEADSDEEEDESDEEETPKKAEIGKKKAA DSATKTPVPAKKSKLPTPQKTDGKKGGHTATPHPAKQAGKNPANSANKSQSPKS AGQVSCKSCSKTFNSDGALQSHSKAKHGGK; | 160 | 1062 |
| 290 | Histone deacetylase | MEFWGVEVKAGQPLKVNPGNAKILHLSQASLGECKSSKGNESVPLHVKFGDQKL VLGTLSTENFPQLAFDLVFEKEFELSHNWKSGSVYFCGYKSVVHDDDDEFSDLE SDSEEEDLPNIGVENGKVAAQASAKTATASANASKVESSGKQKASIPQPMKVDE DDSDEDDDEDDDDEDESDEGVDGEADSDEEEDESDEEETPKKAEIGKKKAADSA TKTPVPAKKSKLPTPQKTDGKKGGHTATPHPAKQAGKNPANSANKSQSPKSAGQ VSCKSCSKTFNSDGALQSHSKAKHGGK | 172 | 1077 |
| 291 | Histone deacetylase | MEFWGVEVKSGEPLNVEPGAETVVHLSQACLGETKEKTKESVLLYVHIGVQKLV LGTLSADKFPQIPFDLVFEKSFKLSHNWKNGSVFFSGYKTLLPCGSDADSPYSD SDTDEGLPINVTAQADVPAKKAPVTANANAAKPNLASAKQKVKIVESNEDGKNE GDDDEDADVSSDDDAEDDSGDEDNVDGGDESSDEDDDDSEEGESSEEEEPKAQP SKKKPADSVLKTPASDKKSKLETPQKTDGKKASEHVATPYPSKQAGKAIASKGQ AKQQTPNSNEFSCKPCNKSFKSDQALQSHNKAKHGGS | 66 | 989 |
| 292 | Histone deacetylase | MDTGGNSLPSGPDGVKRRVCYFYDPEVGNYYLLQHMQVLRPVPARDRDLCRFHA DDYVAFLRSITPETQQDQLRQLRRFNVGEDCPVFDGLHSFCQTYAGGSVGGAVR LNHGLCDIAINWAGGLHHARRCEASGFCYVNDIVLGILELLRQHERVLYVDIDI HHGDGVEEAFYTTDRVNTVSFHKFGDYFPGTGDIRDIGYGKGRYYSLNVPLDDG IDDESYHSLFRPIIGRVMEVFRPGAVVLQCGADSLSGORLGCFNLSIRGHAECV RYMRSFNVPVLLLGGGGYTIRNVARCWCYETGVALGLEVDDRMPQHEYYEYFGP DYTLHVAPSNMENRNSRQLLEEIRSRLLENLSRLQHAPSVPFQERPPDTELPEA | 111 | 1541 |

TABLE 15-continued

Peptide Table.

| Protein SEQ ID | Target | Patent PEPTIDE Sequence | Patent ORF start | Patent ORF stop |
|---|---|---|---|---|
| | | DEDQEDPDERWDPDSDMDVDEDRRPLPSRVRRELIVEPEVRDQDSQRASIDHGR GLDTTQEDNASIRVSDMNSNITDEQSVRNEQDNVNRPSEQIFPR | | |
| 293 | Histone deacetylase | MDTGGNSLPSGPDGVRRRVCYFYDPEVGNYYYGQHPMKPHRIRMTHALLAHYG LLQHMQVLRPVPARDRDLCRFHADDYVAFLRSITPETQQDQLRQLRRFNVGEDC PVFDGLHSFCQTYAGGSVGGAVRLNHGLCDIAINWAGGLHHARRCEASGFCYVN DIVLGILELLRQHERVLYVDIDIHHGDGVEEAFYTTDRVHTVSFHRFGDYFPGT GDIRDIGYGRGRYYSLNVPLDDGIDDESYHSLFRPIIGRVMEVFRPGAVVLQCG ADSLSGDRLGCFNLSIRGHAECVRYNRSFNVPVLLLGGGGYTIRNVARCWCYET GVALGLEVDDRNPQHEYYEYFGPDYTLHVAPSNMENRNSRQLLEDIRSRLLENL SRLQHAPSVPFQERPPDTELPEADEDQEDPDERWDPDSDMDVDEDRRPLPSRVR RELIVEPEVRDQDSQRASIDHGRGLDTTQEDNASIRVSDMNSMITDEQSVRMEQ DNVNKPSEQIFPK | 116 | 1615 |
| 294 | Histone deacetylase | MRPKDRISYFYDGDVGSVYFGPNHPMKPHRLCMTHHLVLSYELHTKMEIYRPHK AYPAELAQFHSPDYVEFLHRITPDTQHLFPNDLAKYNLGEDCPVFENLFEFCQI YAGGTIDAARRLNNQLCDIAINWAGGLHHAKKCEASGFCYINDLVLGILELLKY HARVLYIDIDVHHGDGVEEAFYFTDRVMTVSFHKFGDMFFPGTGDVKEIGGKEG KFYAINVPLKDGIDDTSFTRLFKAIISKVVETYQPGAIVLQCGADSLAGDRLGC FNLSIDGHSECVRFVKKFNLPLLVTGGGGYTKENVARCWVVETGVLLDTELPNE IPENEYFKYFAPDYSLKIPRGNIVLENLNSKSYLSAIKVQVLENLRNIQHAPSV QMQEVPPDFYIPDFDEDEQNPDERMDQHTQDKQIQRDDEYYDGDNDNDHNMDDS | 155 | 1453 |
| 295 | Histone deacetylase | MTVAEDFHVNNRSKMVSQATPESRLTGGEDDNSLHNQVDELLCQELPERQVILE FEGTRPKPYFSDHNGGENSALGVRATEDDLNSDVEAEEKQKEMTLEDMYKNDGT LYDDDEDDSDWEPVKRQVELMRWFCTNCTMVNVEDVFLCDICGEHRDSGILRHG FYASPFMQDVGAPSVEAEVQESREDHARSSPPSSSTVVGFDEKMLLHSEVEMKS HPHPERADRLQAIAASLATAGIFPGRCRSLPVREITKEELQMVHSSEHVDAVEM TSHDMFSSYFTPDTYANEHSARAARIAAGLCADLASTIISGRSKNGFALVRPPGH HAGIKHAMGFCLHNNAAVAALAAQGAGAKKVLIVDWDVHHGNGTQEIFDGNKSV LYISLHRHEGGNFYPGTGAAHEVGTMGAEGYCVNIPWSRRGVGDNDYVFAFHHI VLPIASAFAPDFTIISAGFDAARGDPLGCCDVTPAGYAQMTHMLSALSGGKLLV ILEGGYNLRSISSSAVAVIKVLLGDSPISEIADAVPSKAGLRTVLEVLKIQRSY WPSLESIFWELQSQWGMFLVDNRRKQIRKRRRVLVPIWWKWGRKSVLYHLLNGH LHVKTKR | 228 | 2033 |
| 296 | Histone deacetylase | MAAAPSSPPTNRVDVFWHDGMLSHDTGRGVFDTGSDPGFLQVLEKHPENPDRVR NMVSILKRGPISPFISWHTATPALISQLLSFHSPEYINELVEADKNGGKVLCAG TFLNPGSWDAALLAAGNTLSAMKYVLDGKGKIAYALVRPPGHHAQPSQADGYCF LNNAGLAVRLALDSGCKRVVVVDIDVHYGNGTAEGFYQSSDVLTISLHMNHGSW GPSHPQSGSVDELGEOEGYGYNMNIPLPNGTGDRGYEYAVTELVVPAVESFKPE MVVLVVGQDSSAFDPNGRQCLTMDGYRAIGRTIRGLADRHSGGRILIVQEGGYH VTYSAYCLHATVEGILDLPDPLLADPIAYYPEDEAFPVKVVDSIKRYLVDKVPF LKEH | 110 | 1258 |
| 297 | Histone deacetylase | MVESSGGASLPSVGQDARKRRVSYFYEPTIGDYYYGQHPMKPHRIRMAHHLIV HYYLHRRMEISRPPPAATTDIRRFHSEDYVTFISSVTPETVSDPAFSRQLKRFN VGEDCPVFDGIFGFCQASAGGSMGAAVKLNRGDSDIALHWAGGLHHAKKSEASG FCYVNDIVLGILELLKVHKRVLYVDIDVHHGDGVEEAFYTTDRVMTVSFHKFGD FFPGSGHIKDTGAGPGKNYALNVPLNDGIDDESFRGMFRPIIQKVMEVYQPDAV VLQCGADSLSGDRLGCFNLSVKGHADCLRFLRSFNVPLMVLGGGGYTMRNVARC WCYETAVAVGVEPENDLPYNEYYEYFGPDYTLHVEPCSMENLNAPKDLERIRNM LLEQLSRIPHAPSVPFQMTPPITQEPEEAEEDMDERPKPRIWNGEDYESDAEED KSQHRSSNADALHDENVEMRDSVGENSGDKTREDRSPS | 50 | 1462 |
| 298 | MAT1 CDK-activating kinase assembly factor | MVVPSSNPHNREMAIRRRMASTFNKREDDFPSLREYNDYLEEVEEMTFNLIEGV DVPTIEAKIAKYQEENAEQIMINRAKKAEEFAAALAASKGLPPQTDPDGALNSQ AGLSVGTQGQYAPAIAGGQPRPTGMAPQPVPLGTGLDIHGYDDEEMIKLRAERG GRAGGWSIELSKKRALEEAFGSLWL | 176 | 739 |
| 299 | Peptidylpropyl isomerase | MAAIISCHHYHSCCSSLIASKWVGARIPTSCFGRSSTQSNNAASVRQFVTRCSS SPSSRGQWQPHQNGEKGRSFSLRECAISIALAVGLVTGVPSLDMSTGNAYAASP ALPDLSVLISGPPIKDPEALLRYALPINNKAIREVQKPLEDITDSLKVAGLRAL DSVERNVRQASRVLKQGKNLIVSGLAESKKDHGVELLDKLEAGMDELQQIVEDG NRDAVAGKQRELLNYVGGVEEDMVDGFPYEVPEEYKNMPLLKGRAAVDMKVKVK DNPMLEECVFRIVLDGYNAPVTAGNFVDLVERHEYDGMEIQRADGFVVQTGDPE GPAESFIDPSTEKPRTIPLEIMVDGEKAPVYGATLEELGLYKAQTKLPFNAFGT MAMARDEFEDNSASSQIFWLLKESELTPSNANILDGRYAVFGYVTENQDFLADL KVGDVIESVQVVSGLDNLANPSYKIAG; | 150 | 1529 |
| 300 | Peptidylpropyl isomerase | MAGEDFDIPPADEMNEDFDLPDDDDDAPVMKAGDEKEIGKQGLKKKLVKEGDAW ETPDNGDEVEVHYTGTLLDGTQFDSSRDRGTPFKFTLGQGQVIKGWDQGIKTMK KGENAIFTIPPELAYGEAGSPPTIPPNATLQFDVELLSWTSVKDICKDGGIFKK | 247 | 1971 |

TABLE 15-continued

Peptide Table.

| Protein SEQ ID | Target | Patent PEPTIDE Sequence | Patent ORF start | Patent ORF stop |
|---|---|---|---|---|
| | | ILVEGEKWENPKDLDEVLVKYEFQLEDGTTIARSDGVEFTVKEGHFCPAVAKAV KTMKKGEKVLLTVKPQYGFGEKGKPASGDEGAVPPNATLQITLELVSWKTVSEV TDDKKVIKKILKEGEGYERPNEGAVVEVKLIGKLQDGTVFVKKGHDDCEELFKF KIDEEQVVDGLDKAVMNMKKGEVALLTVAPEYAFGSSESKQDLAVVPPSSTVYY EVELVSFVKDKESWDMNTEEKIEAAGKKKEEGNVIFKAGKYAKASKRYEKAVKY IEYDTSFSEDEKKQAKALKVACNLNDAACKLKLKDYNQAEKLCTKVLELDSRNV KALYRRAQAYIELSDLDLAEFDIKKALEIDPHNRDVKLEYKVLKEKVKEFNKKD AKFYGNMFAKMSKLEPVEKTAAKEPEPMSIDSKA; | | |
| 301 | Peptidylpropyl isomerase | MSTVYVLEPPTKGKVVLNTTHGPLDVELWPKEAPKAVRNFVQLCLEGYYDNTIF HRIIKDFLVQGGDPTGSGTGGESIYGDAFSDEFHSRLRFKHRGLVACANAGSPH SNGSQFFITLDRCDWLDRKNTIFGKITGDSIYNLSGLAEVETDKSDRPLDPPPK IISVEVLWNPFEDIVPRAPVRSLVPTVPDVQNKEPKKKAVKKLNLLSFGEEAEE EEKALVVVKQKIKSSHDVLDDPRLLKEHIPSKQVDSYDSKTARDVQSVREALSS KKQELQKESGAEFSNSFREIAQDEDDDDDDASFDARMRRQILQKRKELGDLPPK PKPKSRDGISARKERETSISRDKDDDDDDDQPRVEKLSLKKKGIGSEARGERMA NADADLQLLNDAERGRQLQKQKKHRLRGREDEVLTKLETFKASVFGKPLASSAK VGDGDGDLSDWRSVKLKFAPEPGKDRNTRNEDPNDYVVVDPLLEKGKEKFNRMQ AKEKRRGREWAGKSLT; | 136 | 1644 |
| 302 | Peptidylpropyl isomerase | MASAISMHSSGLLLLQGTNGKDVTEMGKAPASSRVANMQQRKYGATCCVARGLT SRSHYASSLAFKQFSKTPSIKYDRMVEIKAMATDLGLQAKVTNKCFFDVEIGGE PAGRIVIGLFGDDVPKTVENFRALCTGEKGFGYKGCSFHRIIKDFMIQGGDFTR GNGTGGKSIYGSTFEDENFALKHVGPGVLSMANAGPSTNGSQFFICTVKTPWLD NRHVVFGQVVDGNDVVQKLESQETSRSDVPRQPCRIVNCGELPLDG; | 48 | 836 |
| 303 | Peptidylpropyl isomerase | MAASFTALSNVGSLSSPRNGSEIRRFRPSCNVAASVRPPPLKAGLSASSSSSFS GSLRLIPLSSSPQRKSRPCSVRASAEAAAQSKVTNKVYLDISIGNPVGKLVGR IVIGLYGDDVPQTAENFRALCTGEKGFGYKGSTVHRVIKDFMIQGGDFDKGNGT GGKSIYGRTFKDENFKLSHVGPVVSMANAGPNTNGSFFICTVKTPWLDQRHV VFGQVLEGMDIVRLIESQETDRGDRPRKRVVVSDCGELPVV; | 49 | 822 |
| 304 | Peptidylpropyl isomerase | MAEAIDLTGDGGVMKTIVRRAKPDAVSPSETLPLVQVRYEGVLAETGEVFDSTH EDNTLFSFEIGKGSVISAWDTALRTMKVGEVAKITCKPEYAYGSTGSPPDIPPD ATLIFEVELVACKPCKGFSVTSVTEDKARLEELKKQREIAAATKEEEKKRREEA KAAAAARVQAKLDAKKGHGKGKGKAK; | 185 | 751 |
| 305 | Peptidylpropyl isomerase | MGNPKVFFDMSIGGQPAGRIVMELYADVVPRTAENFRALCTGEKGAGRSGKPLH YKGSSFHRVIPGFNCQGGDFTAGNTGGESIYGSKFADENFVKKHTGPGVLSMA NAGPGTNGSQFFVCTAKTEWLDGKHVVFGQIVQGMDVVKAIEKVGSSSGRTSKP VVVADCGQLS | 103 | 621 |
| 306 | Peptidylpropyl isomerase | MPNPKVFFDMTIGGAAAGRVVMELYADTTPRTAENFRALCTGEKGVGRSKKPLH YKGSKFHRVIPSFMCQGGDFTAGNGTGGESIYGVKFADENFIKKHTGPGILSMA NAGPGTNGSQFFICTTKTEWLDGKHVVFGKVVEGMEVVKAIEKVGSSSGRTSKP VVVADCGQLP | 41 | 559 |
| 307 | Peptidylpropyl isomerase | MAEAIDLTGQGGVMKTIVRRAKPDAVSPSETLPLVDVRYEGVLAETGEV~DSTH EDNTLFSFEIGKGSVISAWDTALRTMKVGEVAKITCKPEYAYGSTGSPPDIPPD ATLIFEVELVACKPCKGFSVTSVTEDKARLEELKKQREIAAATKEEEKKRREEA KAAAAARVQAKLDAKKGHGKGKGKAK | 127 | 693 |
| 308 | Peptidylpropyl isomerase | MATARSFFLCALLLLATLYLAQAKKSEDLKEVTHKVYFDVEIACKPAGRIVMGL YGKAVPKTAENFRALCTGEKGTGKSGKPLHYKGSSFHRIIPSFMLQGGDFTLGD GRGGESIYGEKFADENFKLKHTGPGLLSMANAGPDTNGSQFFITTVTTSWLDGR HVVFGKVLSGMDVVYKVEAEGRQSGTPKSKVVIADSGELPL | 28 | 639 |
| 309 | Peptidylpropyl isomerase | MMRREISVLLQPRFVLAFLALAVLLLVFAPFFSRQRGDQVEEEPEITHRVYLDV DIDGQHLGRIVIGLYGEVVPRTVENFRALCTGEKGKSANGKKLHYKGTPFHRII SGFMIQGGQVIYGDGKGYESIYGGTFADENFRIKHSHAGIISMVNSGPDSNGSQ FFITTVKASWLDGEHVVFGRVIQGMDTVYAIEGGAGTYNGRPRKKVIIADSGEI PKSKWDEER | 135 | 812 |
| 310 | Peptidylpropyl isomerase | MWATAEGGPPEVTLETSMGSFTVELYFKHAPRTSRNFIELSRRGYYDNVRFHRI IKDFIVQGGDPTGTGRGGESIYGKKFEDEIKPELKHTGAGILSMANAGPNTNGS QFFITLAPCPSLDGKHTIFGRVCRGMEIIKRLGSVQTDNNDRPIHDVKILRTSV KD | 119 | 613 |
| 311 | Peptidylpropyl isomerase | MSNPKVFFQILIGKMKAGRVVMELFAQVTPKTAENFRALCTGEKGIGRSGKPLH YKGSTFHRIIPNFMCQGGDFTRGNTGGESIYGMKFADENFKIHKTGLGVLSMA NAGPDTNGSQFFICTEKTPWLDGKHVVFGKVIDGYNVVKEMESVGSDSGSTRET VAIEDCGQLSEN | 38 | 562 |

TABLE 15-continued

Peptide Table.

| Protein SEQ ID | Target | Patent PEPTIDE Sequence | Patent ORF start | Patent ORF stop |
|---|---|---|---|---|
| 312 | Peptidylpropyl isomerase | MDDDFEFPASSNVENDDDDGMDMDDMGGDVPEEEDPVASPAVLKVGEEREIGKA GFKKKLVKEGEGWTEPSSGDEVEVHYTGTLLDGTKFDSSRDRGTPFKFKLGRGQ VIKGWDEGIKTMKKGENAIFTIPPELAYGESGSPPTIPPNATLQFDVELLSWSS VKDICKDGGILKKVLVEGEKWDNPKDLDEVFVKYEASLEDGTLISKSDGVEFTV GDGYFCAALAKAVKTMKKGEKVLLTVMPQYAFGETGRPASGDEAAVPPDASLQI MLELVSWKTVSDVTRDKKVLKKTLKEGEGYERPNDGAAVQVRLCGKLQDGTVFV KKDDEEPFEFKIDEEQVIDGLDRAVKNMKKGEVALVTIQPEYAFGPTESQQDLA VVPANSTVYYEVELLSFVKEKESWEMMNQEKIEAAARKKEEGNAAFKAGKYVRA SKRYEKAVRFIEYDSSFSDEEKQQAKTLKNTCNLNDAACKLKLKDFKEAEKLCT KVLEGDGKNVKALYRRAQAYIQLVDLDLAEQDIKKALEIDPNNRDVKLEYKILK EKVREYNKRDAQFYGNMFAKMNKLEHSRTAGMGAKHEAAPMTIDSKA | 109 | 1872 |
| 313 | Peptidylpropyl isomerase | MAKPRCFMDISIGGELEGRIVGELYTDVAPKTAENFRALCTGEKGIGPHTGAPL HYKGVRFHRVIKGFMVQGGDISAGDGTGGESIYGLKFEDENFDLKHERKGMLSM ANSGPNTNGSQFFITTTRTSHLDGKHVVFGRVVKGMGVVRSVEHVTTAAGDCPT VDVVIADCGEIPAGADDGIRNFFKDGDTYPDWPADLDESPAELSWWMDAVDSIK AFGNGSYKKQDYKMALRKYRKALRYLDICWEKEGIDEVESSSLRKTKSQIFTNS SACKLKLCDLKGALLDAEFAVRDGENNAKAYFRQGQAHMELNDIDAAAESFSKA LELEPNDVGIKKELNAAKRKIFERREQEKRAYRKMFL | 74 | 1159 |
| 314 | Peptidylpropyl isomerase | MTKRKNPLVFLDVSIDGDPVERIVIELFADTVPRTAENFRSLCTGEKGVGKTTG KPLHYKGSYFHRIIKGFMAQGGDFSNGNGTGGESIYGGKFADENFKLAHDGPGL LSMANGGPNTNGSQFFIIFKRQPHLDGKHVVFGKVNRGMEVVKKIEQVGSANGK PLQPVKIVDCGETSETGTQDAVVEEKSKSATLKAKKKRSARDSSSESRGKRRQR KSRKERTRKRRRYSSSDSYSSESSDSDSESYSSDTESESKSHSESSVSDSSSSD GRRRKRKSTEREKLRRQRGKDSRGEQKSARYQRESREKSADSSSDSESESSSES RSRDDKKKSSRRESARSVSKLKDAEANSPENLESPRDREIKKVEDNSSHEEGEF SPENDVQHNGEGTDAKFGKYDQQEPESDGSKESSGSMEDSPERLANSVPQGSPS SSPAHKASEPSSSIRARNPSRSPAPDGNSKRIRKGRGFTERFSYARRYRTPSPE DVTYRPYHYGRRNFHDRRNDRYSNYRSYSERSPHRRYRSPPRGRSPPRYQRRRS ESESVSESPGGNEGEYRGEDQSESESESESPEEGSSPANKQLPLSERLESRL GTEVDEHSPEEEESSSRSHDSSSESPDEVPDKHEGKAAPVSPARSESSSPSGE GLVSYGDASPDSGIN | 54 | 2045 |
| 315 | Peptidylpropyl isomerase | MSVLLVTSLGDIVVDLHADECPLTCKNFLKLCEIKYYNGCVFHTVQKDFTAQTG DPTGTGTGGDSVYKFLYGDQAEFFNDEIHLDLKHSKTGTVAMASGGENLNASQF YFTLEDDLDYLDGRHTVFGEVAEGLETLTEINEAYVDEKGEPYKNIRIEHTYIL DDFFDDPPQLAELIPDASPEGKPKDEVVDDVELEDDWVPLDEQLGPAQLEEAIE AKEAHSEAVVLESIGDIPDAEIKPPDNVLFVCKLNPVTEDEDLHTIFSEFGTVV SADVIRDFKTGDSLCYAFIEFENKDSCEQAYFKNDNALIDDRRIKVDFSQSVAK LWSQFKEKDSQAAKGKGCFKCGAPDHMARECPGSSTRQPLSKYILKEDNAQEGG DDSEYEMVFDEDAPESPSHGKKEEGEDDEDDRHKMSEQSVEETKFNDEEGGHSV DKHEQSEESKHEEDEMSEDSKASEAGEEEIDEDFPEEEEDGEKYTESHEDEDGK RGDYEDYEKGRADVQTHGDERGDENYEEKSAAYDDGHEGAGAAREKDSNDDHHA YREGYGDSEKGTEDEDDDGEGEEDDPSYEESSGHKDSSNGGEEEQKYRSGETDG KSHPERSNEGDEEE | 53 | 1879 |
| 316 | Peptidylpropyl isomerase | MRPFNGGSSIACLVLVIAAGALAESQGPHLGSARVVFQTNYGDIEFGFFPGVAP RTVDHIFKLVRLGCYNTNHFFRVDKGFVAQVADVANGRTAPMNDEQRTEAEKTI VGEFSNVKHVRGILSMGRYDDPDSAQSSFSILLGDAPHLDGKYAIFGRVTKGDE TLKKLEQLPTRREGMFVMPTERITILSSYYYDTGAESCEEENSTLRRRLAASAV EVERQRMKCFP | 7 | 690 |
| 317 | Peptidylpropyl isomerase | MPNPKVFFDMQVGGAPAGRIVMELYADVVPKTAENFRALCTGEKGTGRSGKPLH FKGSSFHRVIPGFMCQGGDFTRGNGTGGESIYGEKFADENFVKKHTGPGILSMA NAGPNTNGSQFFICTAQTSWLDGKHVVFGQVVEGLEVVRDIEKVGSGSGRTSKP VVIADSGQLA | 83 | 601 |
| 318 | Peptidylpropyl isomerase | MRFTSITSAIALFAAAASALDKPLDIKVDKAVECSRKTKAGDKIQVHYRGTLEA DGSEFDASYKRGQPLSFHVGKGQVIKGWDQGLLDNCPGEKRTLTIQPDWGYGSR GMGPIPANSVLIFETELVEIAGVAREEL | 125 | 535 |
| 319 | Peptidylpropyl isomerase | MGNPKVFFDMSIGGQPAGRIVMELYADVVPRTAENFRALCTGEKGAGRSGKPLH YKGSSFHRVIPGFMCQGGDFTAGNGTGGESIYGSKFADENFVKKHTGPGVLSMA NAGPTNGSQFFVCTAKTEWLDGKHVVFGQIVDGMDVVKAIERVGSSSGRTSKP VVVADCGQLS | 55 | 573 |
| 320 | Peptidylpropyl isomerase | MAVATRSRWVAMSVAWILVLFGTLALIQNRLSDTGASSDPKLVHRKVGEEKKKP DDLEEVTHKVFFDVEIGGKPAGRIVMGLFGKTVPKTVENFRALCTGERGIGKSG KPLNYKGSQFHRIIPKFMIQGGDFTLGDGRGGESIYGNKFSDENFKLKHTDAGR LSMTNAGPDTNGSQFFITTVTTSWLDGRHVVFGKVLSGMDVVHIUEAEGGQSGQ PKSIVVISDSGELDL | 147 | 842 |

TABLE 15-continued

Peptide Table.

| Protein SEQ ID | Target | Patent PEPTIDE Sequence | Patent ORF start | Patent ORF stop |
|---|---|---|---|---|
| 321 | Peptidylpropyl isomerase | MAVTLHTNLGDIKCEIFCDEVPKAAEHNARGILSMANSGPNTNGSQFFIAYAKQ PHLNGLYTIFGRVIHGFEVLDIMEKTQTGPGDRPLAEIRLNRVTIHANPLAG | 167 | 487 |
| 322 | Peptidylpropyl isomerase | MAVATRSRWVANSVAWILVLFGTLALIQNRLSDTGASSDPKLVHRKVGEEKKKP DDLEEVTHKVFFDVEIGGKPAGRIVMGLFGKTVPKTVENFRALCTGEKGIGKSG KPLNYKGSQFHRIIPKFMIQGGDFTLGDGRGGESIYGNRFSDENFKLKHTDAGR LSMANAGPDTNGSQFFITTVTTSWLDGRHVVFGKVLSGMDVVHKIEAEGGQSGQ PKSIVVISDSGELDL | 195 | 890 |
| 323 | Peptidylpropyl isomerase | MGNPKVFFDMSIGGQPAGRIVMELYADVVPRTAENFRALCTGEKGAGRSGKPLH YKGSSFHRVIPGFMCQGGDFTAGMGTGGESIYGSKFA0ENFVKKHTGPGVLSMA NAGPGTNGSQFFVCTAKTEWLDGKHVVFGQIVDGMDVVKAIEKVGSSSGRTSKP VVVADCGQLS | 68 | 586 |
| 324 | Retinoblastoma related protein | MSPVAANAMEEAAEFEVPAPVTPSKDDADTDAAVSRFLGFCKSKLGLAEGNCVQ SSTLLRKTAHVLRSSGTVIGTGTAEEAERYWFAFVLYTVRRVGERKAEDEQNGS DETEVPLSRILKASVLNLIDFFKEIPQFVIKAGAIVSGIYGANWDSRLEAREMQ TNYVHLCILCKFYKRICGEFFILNDAKDDMKSADSSTSQPVIMYQPFGWLLFLA LRIHALSRFKDLVSSTNALVSVLAILIIHLPTRFRKFSISDSSQLVKRSEKGVD LVGSLAYRYDTSEDEIKRTLEKANNVIAEILGITPPPASECKAENLENVDTDGL IYFGNLMEETSLSSILSTLEKIYEDATRNDSEFDERVFINDDDSLLVSGSLSGA AINLTGAKRKYDSFASPAKTITRPLSPSRSPASHINGIIGGTNLRITATPVATA MTTAKWLRTFVSPLPSKPSTDLQGFLASCDRDVTSDVIRRANIILEAIFFNSPI GERTVTGGLQNANLMDNMWAEQRRLEALKLYYRVLEAMCRAEAQILHSNNLTSL LTNERFHRCMLACSAELVLATHKTVTMLFPAVLERTGITAFDLSKVIESFVRHE ETLPRELRRHLNTLEERLLENMVWERGSSMYNSLVVARPALAPEINRLGLLPEP MPSLDAIALLINFSSSGLPQSPVQKHEASPGQNGDIRSPKRISTEYRSVLVERN FTSPVKDRLLALSNIKSKLPPPLQSAFASPTRPHPGGGGETCAETAIHIFFSK ITKLAAVRINANLERLQLSQQIKEGVYCLFQQILSQRTNLFFNRHIDQVILCCF YGVAKINQINLTFREIIYNYRKQPCKPQVFRNVFVDWSTRRNGKAGNEHVDII SFYNEIFIPSVKPLLVELGPTGATTRTNRTSEVGNKNDAQCPGSPKISSFPTLP DMSPKKVSASHNVYVSPLRSSKNDASISHSSKSYYACVGESTHAYQSPSKDLVA INSRLNGNRKVRGTLNFDDVDAGLVSDSMVANSLYLQNGSSMSSSTAKSSEKPE S | 182 | 3265 |
| 325 | WD40 repeat protein | MRPILMKGHERPLTFLKYNREGDLLFSCAKDHTPTVWFADNGERLGTYRGHNGA VWCCDVSRDSMRLITGSADTTAKLWSVQNGTQLFTFNFDSPARSVDFSIGDKLA VITTDPFMELPSAIHVKRIARDPADQASESVLVLRGHQGRIARAVWGPLNKTII SAGEDAVIRIWDSETGKLLRESDKETGHKKAVTSLMKSVDGSHFVTGSQDKSAK LWDIRTLTLI KTYVTERPVNAVTMSPLLDHVVLGGGQDASAVTMTDHRAGKFEA KFFDKILQEEIGGVKGHFGPINALAFNPDGKSFSSGGEDGYVRLHHFDPDYFNI KI | 165 | 1145 |
| 326 | WD40 repeat protein | MDKKRTVVPLVCHGHSRPVVDLFYSPITPDGFFLISASKDSSPMLRNGETGDWI GTFEGHKGAVWSCCLDTNALRAASGSADFSAKLWDALSGDELHSFEHKHIVRSC AFSEDTHLLLTGGVEKILRIFDLNRPDAPPREVDNSPGSIRTVAWLHSDQTILS SCTDIGGVRLWDVRSGKIVQTLETKSPVTSSEVSQDGRYITTADGSTVKFWDAN HFGLVKSYNNPCNIESASLEPKLGNKFIAGGEDMWVHIFDFHTGEEIGCNKGHH GPVHCVRFSPGGESYASGSEDGTIRIWQTGPANNVEGDANPSNGPVTGKARVGA DEVTRKVEDLQIGKEGKDWREG | 529 | 1569 |
| 327 | WD40 repeat protein | MAEGLILKGTMRAHTDMVTAIAIPIDNSDMVVTSSRDKSIILWHLTKEEKVYGV PRRRLTGHSHFVQDVVLSSDGQFALSGSWDGELRLWDLATGVSARRFVGHTKDV LSVAFSIDNRQIVSASRDRTIKLWNTLGECKYTIQEGEAHTDWVSCVRFSPNTL QPTIVSASWDRTIKVWMNLTNCKLRNTLAGHNGYVNTVAVSPDGSLCASGGKDV ILLWDLAEGKRLYNLEAGAIIHSLCFSPNRYWLCAATENSIKIWDLESKSIVED LRVDLKNEADKTDGTTTAASNKKVIYCTSLNWSADGSTLFSGYNDGVIRVWGTG RY | 156 | 1136 |
| 328 | WD40 repeat protein | MAEGLHLKGTMKAHTDMVTAIAVPIDNADMIVTSSRDKSIILWHLTKEDKVYGV PRRRLTGHSHFVQDVVLSSDGQFALSGSWDGELRLWDLATGVSARRFVGHTKDV LSVAFSIDMRQIVSASRDRTIKLWNTLGECKYTIQEGEAHNDWVSCVRFSPNTL QPTIVSASWDRTVKVWNLTNCKLRNTLQHSGYVNTVAVSPDGSLCASGGKDGV ILLWDLAEGKKLYSLEAGAIIHSLCFSPNRYWLCAATENSIKIWDLESKSIVED LRVDLKNEADMSDGTTGAMSSNKKVIYCTSLNWSADGSTLFSGYNDGVIRVWGI GRY | 90 | 1073 |
| 329 | WD40 repeat protein | MAEGLHLKGTMKAHTDMVTAIAVPIDNADMIVTSSRDKSIILWHLTKEDKVYGV PRRRLTGHSHFVQDVVLSSDGQFALSGSWDGELRLWDLATGVSARRFVGHTKDV LSVAFSIDNRQIVSASRDRTIKLWNTLGECKYTIQEGEAHNDWVSCVRFSPNTL QPTIVSASWDRTVKVWNLTNCKLRNTLQHSGYVNTVAVSPDGSLCASGGKDGV | 66 | 1049 |

TABLE 15-continued

Peptide Table.

| Protein SEQ ID | Target | Patent PEPTIDE Sequence | Patent ORF start | Patent ORF stop |
|---|---|---|---|---|
| | | ILLWDLAEGKKLYSLEAGAIIHSLCFSPNRYWLCAATENSIKIWDLESKSIVED LRVDLKNEADMSDGTTGAMSSNKKVIYCTSLNWSADGSTLFSGYNDGVIRVWGI GRY | | |
| 330 | WD40 repeat protein | MSGVPAPPFATTTPENGTMSSNSPAFHRDSDDDDQGEVFLDDSDIIHEVAVDD EDLPDADDEADEAEEADDSLHIFTGHNGEVYSLACSPTQATLVATGAGDDKGFL WRIGHGDWAVELQGHKDSISSLAFSLDGQLLASGSLDGVIQIWDVPSGNLKGTL DGPGGGIEWIRWHPKGHIILAGSEDSTVWMWNADKMAYLNMFSGHGNSVTCGDF TPDGKTICTGSDDATLRIWNPKSGENIHVVKGHPYHAEGLTSMAISSDSGLAIT GAKDGSVRIVNISSGRVVSSLDAHADSVEFVGLALSSPWAATGSLDQKLIIWDL QHSSPRATCDHEDGVTCLSWVGASRFLASGCVDGKVRVWDSLSGDCVRTFHGHS DAIQSLSVSANEEFLVSVSIDGTARVFEIAEFH | 277 | 1512 |
| 331 | WD40 repeat protein | MGTSQHQLSSCLQLLPRRRGNKNLIFRRTMASGGAAAVAPPPGYKPYRHLKTLT GHVAAVSCVKFSNDGTLLASASLDKTLIIWSSAALSLLHRLVGHSEGVSDLAWS SDSHYICSASDDRTLRIWSSRSPFDCLKTLRGHTDFVFCVNFNPQSSLIVSGSF DETIRIWEVKTGRCLNVIRAHSMPVTSVHFNRDGSLIVSGSHDGSCKIWDTKNG ACLKTLIDDTVPAVSFAKFSPNGKFILVATLNDTLKLWNYATGKFLKIYTGHKN SVYCLTSTFSVTUGKYIVSGSEDRCICIWDLQGKNLIQKLEGHSDTVISVTCHP SENKIASAGLDSDRTVRIWLQDA | 33 | 1076 |
| 332 | WD40 repeat protein | MPSQKIETGHQDIVHDVANDYYGKRVATASSDTTIKIIGVSNSSGSQHLASLSG HKGPVWQVAWAHPKFGSILASCSYDGQVILWKEGNDWAQAHVFNDHKSSVNS IAWAPHELGLCLACGSSDGNISVFTARPDGGWDTTRIEQAEPVGVTSVSWAPSM APGALVGSGLLDPVQKLASGGCDNTVKVWKLYNGTWKMDCFPALQMHSDWVRIJV AWAPNLGLPKSTIASASQDGTVVIWTVAKEGEGWQQGKVLKDFKTPVWRVSWSLT GNLLAVADGNNNVTLWNEAVDGEWQQVTTVEP | 65 | 973 |
| 333 | WD40 repeat protein | MKIAGLKSVENAHDESVWAAAWVPATESRPALLLTGSLDETVKLWRPDELALER TNAGHFLGVVSVAAHPSGVIAASASIDSFVRVFDVDTNATIATLEAPPSEVWQM QFDPKGTTLAVAGGGSASIKLWDTATWELNATLSIPRPEQPKPSEKGNKKFVLS VAWSPDGRRLACGSMDGTISIFDVARAKFLHHLEGHFMPVRSLVFSPVEPRLLF SASDDAHVHMYDSEGKSLVGSMSGHASWVLSVDVSPDGAALATGSSDRTVRLWD LSMRAAVQTMSNHSDQVWGVAFRPMAGAGVRAGGRLASVSDDKSISLYDYS | 82 | 1047 |
| 334 | WD40 repeat protein | MEIDLGNLAFDVDFHPSEQLVASGLITGDLLLYRYGDGSSPEKLLEVRAHGESC RAVRFINDGKAILTGSPDCSILATDVETGSVVARVENAHEAAVNRLVNLTESTI ATGDDNGCIKVWDTRQRSCCNTFSAHEDFISDMTFASDSMKLVVTSGDGTLSVC NLRSNKVQTRSEFSEDELLSVVIMKNGRKVVCGTQSGTLLLYSWGFFKDCSDRF VDLSPSSVDALLKLDEDRIIAGTENGLISLIGILPNRIIQPIAEHSDHPIERLA FSHDKKFLGSISHDQTLKLWDLNDILGSEDSPSSQAAIDDSDSDEMDVDANPPD SSKGNKKKHSGRGNDVGNANNFFADLGD | 43 | 1101 |
| 335 | WD40 repeat protein | MSQQPSVILATASYDHTIRFWEAKSGRCYRTIQYPDSQVNRLEITPHKRYLAVA GNPSIRLFDVNSNTPQPVMSFDSHTNNVMAVGFQYDGNWMYSGSEDGTVRIWDL RARGCQREYESRGAVNTVVLHPNQTELISGDQNGNIRVWDLTANSCSCELVPEV DTAVRSLTVMWDGSLVVAANNNGTCYVWRLLRGSQTMTNFEPLHKLQAHNGYIL KCLLSPEFCEPHRYLATASSDHTVKIWNVEGFTLEKTLIGHQRWVWDCVFSVDG AYLITASSDTTARLWSMSTGQDIRVYQGHHKATTCCALHDGAEGSPG | 142 | 1095 |
| 336 | WD40 repeat protein | MEDAMDMEVEVEVEAEEHSPSSSNPSGSSFRRFGLKNSIQTNFGSDYVFEITPK FDWSLMGVSLSSNAVKLYSPTTGQYCGECRGHSDTVNGISFSGPSSPHVLHSCS SDGTIRAWDTRSFKEVSCISAGPSQEIFSFSFGGSSQSLLSAGCKSQILFWDWR NKKQVACLEDSHVDDVTQVCFVPHHQNKLISASVDGLICIFDTAGDIMDDEHME SVINVGTSIGKVGIFGQTFEKLWCLTHIETLSVWDWKEGTNEANEFEDARKLASD SWSLDHIDYFVDCHSAEEGEGLWVIGGTNAGTLGYFPVKYKGGAAIGSPEAVLG GGHSDVVRSVLPMSGMAGTTSKTRGIFGWTGGEDGRLCCWLSDDSSATSRSWMS SNLVLKSSRSHHKRNRHQPY | 61 | 1257 |
| 337 | WD40 repeat protein | MSQEQEYPMEYAADDYDVGEVEDDMYFHERVMGDSDTDEDEEYDHLDNKITDTS AADARRGKDIQGIPWERLSVTREKYRRTRIEQYKNYENVPQSGESSEKDCKPTR KGGNYYEFWRNTRSVKSTILHFQLRNLVWSTTKHDVYLMSHFSIIHWSSLTCKK TEVLDVYGHVAPREKHPGSLLEGFTQTQVSTLAVRDKLLIAGGFQGELICKNLD RPGVSYCCRTTYDDNAITNAVEIYDYPSGAVHFMASNNDCGVRDFDNEKFELSR HFTFPWPVNHTSLSPDGKLLVIVGDNPEGIVVDSQRGKTIRPLQGHLDFSFASA WHPDGHIFATGNQDKTCRIWDIRNLSKSVAVLKGNLGAIRSIRFTSDGRFMAMA EPADFVHVYDVKSGYEKEQEIDFFGEISGVSFSPDTESLFVGVWDRTYGSLLQY NRCRNYSYLDSM | 193 | 1527 |
| 338 | WD40 repeat protein | MGASSDPNPDVSDEEQKRSEIYTYEAPWHIYAMNWSVRRDKKYRLAIASLLDHP AAAAAVPNRVEIVQLDDSTGEIRADPNLSFDHPYPATKAAFVPDKDCQRADLLA TSSDFLRIWRIADDSSRVDLRSFLNGNKNSEFCRPLTSFDWNEAEPKRIGTSSI DTTCTIWDIERETVDTQLIAHDKEVYDIAWGGVSVFASVSADGSVRVFDLRDKE | 109 | 1155 |

TABLE 15-continued

Peptide Table.

| Protein SEQ ID | Target | Patent PEPTIDE Sequence | Patent ORF start | Patent ORF stop |
|---|---|---|---|---|
| | | HSTIIYESSEPDTPLVRLGWNKQDPRYMATIIMDSAKVVVLDIRYPTMPVVELQ RHQASVNAIAWAPHSSCHICTAGDDSQALIWDLSSMAQPVEGGLDPILAYTAGA EIEQLQWSSSQPDWVAIAFSLKLQ | | |
| 339 | WD40 repeat protein | MRGGGGGDATGWQEDAYRESVLKEREVQTRTVFRAAFAPSPSPSPDAVVVA SSDGSVASYSISACLSDHRLQSLRFADAKSQNVLEAEPACFLQGHDGPAYDVRF YGEGEDSLLLSCGDDGRIRGWMWRDITSSEAHDHSQGNSAKPVLDLVNPQSRGP WGALSPIPENNALAVDVKRGSIYAAAGDSCAYCWDVECGKIKTVFKGHSDYLHC IAARNSSSQIITGSEDGTARIWDCRSGKCVQVIDPDKDHKRGFFASVSCLALDA SESWLVCGRGRDLSVWSISASDCIAKISTNAPAQDVLFDDNQILLVGAEPLISR LDMNGAVLSQIHCAPQSVFSVSLHQSGVTAVGGYGGLVDVISQFGSHLCTFRCK CI | 71 | 1213 |
| 340 | WD40 repeat protein | MEAPIIDPLQGDFPEVIEEYLEHGIMKCIAFNRRGTLLAAGCTDGSCIIWDFET RGVAKELRDKECTAAITSVCWSKYGHRILVSASDKSLILWDVLSGEKIAHTTLQ HTVLQACLHPGSSTPSICLACPFSSAPMIVDLNTGSTTALPVLTADVSNGATPL SRNKTSDTSVTYSPCNACFNKHGDLVYAGTSKGEILIIDHKNVRVCAIVLVSGG AVIKNVVFSRNGQYMLTNSNDRLIRIYKNLLPPKDGLKMLDELNESFWESDDVE KLKAIGSKCLELLHEFQDSITRVQWKAPCFSGDGEWVIGGAASRGEHKIYIWDR AGHLVKILEGPKEALMDLAWHPVHPIIISVSLTGLVYIWAKDYTENWSAFAPDF KELEENEEYVEREDEFDLVPETEKVKGLDVHEDDEVDVLTVERDSVFSDSDMSQ EELCFLPAVPCLDIPEQQDKCVGSCSKLPDGNHSGSPLSVEAGQNGNASNHMSS PLEPMENSTADDTDGVRLKRKRKPSEKGLELQAEKVKKPVKPLKSSGRLSKTNK PVIDPDSSNGVYGDDGSD | 109 | 1785 |
| 341 | WD40 repeat protein | MRGVSWPEDGWNPSTSSSSQRNQQQAHAPRAVSGHAASHPSASNIFKLLVQREV SPRRSKHSSKKLWREASKCQPYPFQQSCEAVRDVRQGLISWVESASLRHLSAKYC PLVPPPRSTIAAAFSPDGKILASTHGDHTVKLIDSQTGSCLKVLRGHRRTPWVV RFHPLYPEILASGGSLDHEVRLWDANTAECIGSRNFYRPIASIAFHARGELLAVA SGHKLYIWHYNRRGETSSPTIVLRTQRSLRAVHFHPHAAPFLLTAEVNDLDSAD SAMTLATSPGYLHYPPPTVYFADAHSHERSRLADELPLMPLPLLMWPSFTRDDG RVPLQRIDGDVGLNGQQRVDSSSSVRLWTYSTPSGQYELLLSPVESGNSPSMPE ETGWNAFSSAVEAEVSQSANDTVEDMEVQPEERNTQFFSFSDPRFWELPLLHGW LVGQTQAGPRSVRQSSPGDIETQSAFGEVASVSPITSGVNPVSMDPSRFGGRSG SRYRSPGSRGVHVTGPNNDGPRDENDPQSVVSKLRSELAASLAAAASTELPCTV KLRIWPHDVKDPCAQLDLESCRLTIPHAVLCSEMGAHFSPCGRFLAACVACVLP HLESDPGLHGQVNQDVTGVATSPTRHPISAHQIMYELRIYSLEEATFGIVLASR PVRAAHCLTSIQFSPTSEHLLLAYGRRHSSLLKSIVIDGENTVPIYTILEVYRV SDMELVRVLPSAEDEVNVACFHPSVGGGLIYGTKEGKLRILHYDSSHGLNLKSS GFLDENVPEVQTYALEC | 364 | 2685 |
| 342 | WD40 repeat protein | MDSAVAIAALSLVVGAAIALLFFGNYFRKRRSEVVAMAEADLQPHPKNPSRPPP QPAAKKVHAKSHAHGADKDKNKRHHPLDLNTLKGHGDSVTGLCFASDGRSLATA CADGVVRVFKLDDASNKSFKFLRINLPAGGHPTAVAFGDGVSSVIVASQHLSGC SLYMYGEEKPTNLDSNKQQTKLPMPEIKWEHHKVHEQKAILTLSGAAANYDSGD GSTIIASCSEGTDIIIWHAKTGKILGNVDTNQLKNTMSAISPNGRFIAAAAFTA DVKVWEIVYSKDGSVKGVTKVMQLKGHKSAVTWLCFTPNSEQIVTASKDGSIRI WNINVRYHLDEDTKTLKVFPIPLQDSSGTTLHYERLSLSPDGKILAATHGSMLQ WLCIETGKVLDTAEKAHDGDITCMSWAPQSIPTGDKKVNVLATASGDKKVKLWA APPLPS | 96 | 1412 |
| 343 | WD40 repeat protein | MEVEPKKASKTFPVKPKLKPKPRTPSGKTPESRYWSSFKTTHPLDNLSFSVPSL AFSPSPPHLLAAAHSATVSLFSPHRTTISSFSDVVSSLSFRSDGQLLAASDLSG LIQVFDVRSRTPLRRLRSHARPVRFVRYPVLDKLHLVSGGDDALVKYWDVAGES VVSELRGHKDYVRCGDCSPADANCFVTGSYDHVVKLWDVRVRDGNRAATEVNHG SPVQDVIFLPSGSLVATAGGNSVKIWDLIGGGRNVYSMESHNKTVTSICVGTMG AQQSGEEGVQLRILSVGLDGYMKVFDYSRMKVTHSMRFPAPLLSIGFSPDSNVR AIGTSNGILYVGKRKAKENAEGGANGILGLGSVEEPRRRVLKPSFYRYFHRGQS EKPSEGDYLVMRPKKVKLAEHDKLLKKFQHKNALISVLGGNDPEKVVAVMEELV ARRALLKCVLNLDADELGLILTFLHKNSTVPRYSSLLLGLAKKVIDLRLEDIRA SDALKGHIRNLKRSVDEEIRIQEGLQEIQGMVSPLLRIAGRR | 116 | 1702 |
| 344 | WD40 repeat protein | MQGGSSGVGYGLKYQARCISDVKADTDHTSFLTGTLSLKEENEVHLLRLSSGGT ELICEGLFSHPSEIWDLSSCPFDQRIFSTVFSTGESYGAAVWQIPELYGQLNSF QLEKIASLDAHSRKISCVLWWPSGRHDKLVSIDEENIFLWGLDCSKKSAQVQSQ ESAGMLHNLSGGAWDPHDVNTVAATCESSIQFWDLRTMKKANSLESVHARDLDY DMRKKHLLVTSEDESGVRVWDLRMPKAPIQEFPGHTHWTWAVRCNPDYEGLILS AGTDSAVNLWWSSTASSDELISERLIDSPTRKLDPLLHSYNDYEDSVYGLAWSS REPWIFASLSYDGRVVVESVKPFLSRK | 46 | 1101 |
| 345 | WD40 repeat protein | MAEEEGSAELEQQLEEEFAVWKKNTPILYDLLISHALEWPSLTVHWAPLLPQPS SSAAAAGDPSLAAHRLVLGTHTSDGAPNFLILADALLPSSESDHCGDDAVLPK VEISQKIRVDGEVNRARFD4PQNHNIVGAKTNGCEVYVFDCSKQAAKQHDGGFDP | 23 | 1258 |

TABLE 15-continued

Peptide Table.

| Protein SEQ ID | Target | Patent PEPTIDE Sequence | Patent ORF start | Patent ORF stop |
|---|---|---|---|---|
| | | DLRLTGHDGEGYGLSWSPLKENYLLSASHQKKICLWDISAAAQDKVLGAMHVFE AHEGAVGDASWHSKNDNLFGSAGDDCQLMIWDLRTNKAQQCVKAHEKEVNSVSF NSYNDWILATASSDTTVGLFDNRKLTTPLHVFSSHEGEVLQVEWDPNHEAVLAS SSEDRRVMVWDLNRIGDEQQEGDASDGPAELLFSHGGHKAKISDFSWNKNEPWV ISSVAEDNSVQVWQMAESICGDDDDMQAMEGYI | | |
| 346 | WD40 repeat protein | MGNYGEEQSDQYFQALEETASVSDEGSNSSQCQSSGSGLDENVLQSLGFEFWTK FPESVRARRNRFLMLTGLGISANSVDKEDAFPPSCNEIEVYTCKVTRDDGAVQR SLDSYNCISLLQSSTSIRSNQEVESLRGDSLLSSFRGRSKESDDLTELCGMGCP ESRRNAVSEFGSVSQGSIESLERIVASSPLVHPLLHRKLEYERELIETKQKMGA GWLRKFGSATCISGRQGDTWSDPDDLEITAGMKMRRVRAHSSKKKYKELSSLYA AQEFLAHEGSISTMKFSMDGQYLASAGEDTVVRVWKVTEEDRSERVNVTVDPSC LYFALNESTQLASLNTNKEHIGRAKTFQRSSDDSSCVILPLKVFQITEKPWHEFE GHNGEVLDLSWSSKGYLLSSSTDKTVRLWRVGCDRCQRVYSHNDYVTCISFNPV NENFFISGSIDGKVRIWNVFGGQVVAYIDCREIVSAVCYRSDGKGAIVGTMTGN CLFYSIKDNHLQMDAQVYLHGKKKSPGKRITGFQFPPNDPGKLNITSADSVIRV LSGLDVVCKLKGPRNSGGPNIATFTSDGKHVISASEDSNVYIWNYAGQDKTSSR VKKIWSCESFWSSNASVALPWCGIRTVPEALAPPSRSEERRASCAENGENHHML EEYFQKMPPYSPDCFSLSRGFFLELLPKGSATWPEEKLSDTSPPTVSSQAISKL EYKFLKSACHSVLSSAHNWGLVIVTAGWDGRIRTYHNYGLPVRS | 404 | 2644 |
| 347 | WD40 repeat protein | MDIDFKEYRLRCELRGHEDDVRGVCVCGDGSIGTSSRDRTVRLWAPSAGERRKY EVARVLLGHKSFVGPLAWVPPSEELPEGGIVSGGMDTLVMAWDLRNGEAQTLKG HQLQVTGIVLDGGDIVSASVDCTLIRWKNGQLTEHWEAHKAPIQAVIRLPSGEL VTGSSDTTLKLWRGKTCTQTFVGHTDTVRGLAVMPDLGILSASHDGSIRLWAVS GECLMEMVDHTSIVYSVDSHASGLIVSGSEDRFAKIWKDGVCFQSIEHPGCVWD VKFLEDGDIVTACSDGTIRIWTNQEDRMANSTELELFDLELSSYKRSRKRVGGL KLEELPGLEALQVPGTSDGQTKVIREGDNGVAYAWNSTELKWDKIGEVVDGPED SMNRPALDGVQYDYVFDVDIGDGEPTRKLPYNRSDNPYDTADKWLLKENLPLSY RQQIVEFILANSGQRDFNLDPSFRDPYTGSSAYVPGAPSQLAAKQARPTEKHIP KKGMLVFDAAQFDGILKKINEFNNTLLSNQEKKNLSLTDIEISRLGAVVKILKD TSHYHSSKFADADFDLMLKLLESWPYEMMFPVIDIFRNVILHPDGADGLLRHQE DKKDVLMESIKRATGNPSVPANFLTSIRAVTNLFKNSAYYSWLQKHRSEMLDAF SSCSSSSNKNLQLSYATLLLNYAVLLIEKKDEEGQSQVLSAALELAENESLEVD ARYRALVAIGSLMLDGLVKRIALDFDVEHIAKAARTSKEAKIAEVGADIELLIK QS | 107 | 2383 |
| 348 | WD40 repeat protein | MEFTEAYKQSGPCCFSPNARFIAVAVDYRLVIRDTLSLKVVQLFSCLDRISYIE WALDSEYILCGLYKRPMIQAWSLIQPEWTCKIDEGPAGIAYARWSPDSRHILTT SDFQLRLTVWSLVNTACVHVQWPKHASKGVSFTRDGKFAAICTRHDCKDYINLL SCHNWEIMGVFAVDTLDLADIQWSPDDSAIVIWDSPLEYKVLVYSPDGRCLFKY QAYESGLGVKSVSWSPCGQFLAVGSYDQMLRVLSHLTWKT~AEFTHLSNVRAPC CAAIFKEVDEPLQIDMSELSLSDDYMQGNSGDAPEGHYRVRYDVTEVPITLPCQ KPPADRPNPKQGIGLMSWSNDSQYICTRNDSMPTILWIWDMRHLELAAILVQKD PIRAAVWDPTGTRLVLCTGSSHLYMWTPSGAYCVSVPLSQFNITDLKWNSDGSC LLLKDKESFCCAAAPLPPDESSDYSSDD | 243 | 1625 |
| 349 | WD40 repeat protein | MATIAALDDDMVRSMSIGAVFSDFVGKLNSLDFHRKDDILVTAGEDDSVRLYDI ANARLLKTTFHKKHGTDRVCFTHHPNSLICSSTKNLDTGESLRYISMYDNRSLR YFKGHKQRVVSLCMSPINDSFMSGSLDHSVRNWDLRVNACQGILRLRGRPTVAY DQQGLVFAVAMEGGAIKLFDSRSYDKGPFDAFLVGGDTSEVCDIKFSNDGKSVL LSTTNNNIYVLDAYAGDKQCGFNLEPSPSTPIEASFSPDGQYVVSGSGDGTLHA WNISRRNEVACWNSHIGVASCLKWAPRRAMFVAASTVLTFWIPNSEPELASAKG EAGVPPEQV | 126 | 1127 |
| 350 | WD40 repeat protein | MSVAELKERHRAATETVNSLRERLKQKRVQLLDTDVAGYARTQGKTPVTFGATD LVCCRTLQGHTGKVYSLDWTPERNRIVSVSQDGRFIVWNALTSQKTHAIRLPCA WVMTCAFAPNGQSVACGGLDSVCSIFNLNSPVDRDGNLPVSRNLSGHKGYVSSC QYVPDGDAHLITGSGDQTCVLWDITTGLRTSVFGGEFQSGHTADVLSVSINGSS PRIFVSGSCDSTARMWDTRVASRAVHTYHGHEGDVNAVKFFPDGNRFGTGSDDG TCRLFDIRTGHELQVYYQQRGIDEIPHVTSIAFSISGRLLIAGYSNGDCFVWDT LLAQVVLNLGSLQNSHEGRISCLGVSADGSALCTGSWDTNLKIWAFGGIRRVT | 257 | 1390 |
| 351 | WD40 repeat protein | MKKRPRGASLDQAVVDIRRREVGGLSGLSFARRLAASEGLVLRLDIYNKLKGHR GCVNTVGFNLDGDIVISGSDDRHVKLWDWQTGKVKLSFDSGHLSNVFQAKIMPY TDDRSIVTCAADGQARHAQILEGGQVQTHLLAKHRGRAHKLAIDPGSPHIVYTC GEDGLVQRLDLRSNTARELFTCREVYGTHVEVVHLNAIAIDPRNPNLFVIGGSD EYARVYDIRNYKWNGSHNFGRSANYFCPSHLIGEAHVGITGLAFSGQSELLVSY NDESIYLFTQEMGLGPDPLSASTKSVDSNSSEVTSPTAVNVDDNVTPQVYKGHR NCETVKGVGFFGPKCEYVVSGSDCGRIFIWKKKGGQLIRVMAADKHVVNCIEPH PHIPALASSGIENDIKIWTPKAIERATLPMNVEQLKPKARGWMNRISSPRQLLL QLYSLERWPEHGGETSSGLAAGQEELTELFFALSANGNGSPDGGGDPSGPLL | 178 | 1632 |

TABLE 15-continued

Peptide Table.

| Protein SEQ ID | Target | Patent PEPTIDE Sequence | Patent ORF start | Patent ORF stop |
|---|---|---|---|---|
| 352 | WD40 repeat protein | MSKRGYKLQEFVAHSSNVNCLSIGKKACRLFLTGGDDCKVNLWAIGKPNSLMSL CGHTNAVESVAFDSAEVLVLAGASSGVIKLWDVEEAKMVRGLTGHRSNCTAMEF HPFGEFFASGSTDTNLKIWDIRRKGCIHTYKGHTRGISTIRFSPDGRWVVSGGN DNVVKVWDLTAGKLLHDFKFHENHIRSIDFHPLEFLLATGSADRTVKFWDLETF ELIGSSRPEAAGVRAIAFHPDGRTLFCGLEDSLKVYSWEPVICHDGVDMGWSTL ADLCIHDGKLLGCSYYQSSVGVWVADASLIEPYGTNVKPQQKDSGDDEIEHQES RPSAKVGTTIRSTSIMRCASPDYETKDIKNIYVDTASGNPVSSQRVGTTNFAKV TQPLDFNDTPNLTLRRQGLVTETPDGLSGHVPSKSITQPKVVSRDSPDGKDSSR RESITFSRTKPGMLLRPAHSRRPSSTKYDVDRLSACAEIGVLSSAKSGSESLVD SFLNIKVAPEDGARNGCEDNHSSVKNVSVESERVLPLQTPKTEKCDQTVGFKEE INSVKFVNGVAVVPGRTRTLVEKFEKREKLNSTEDQTINTPENPTLDKTPPPSL AENEEKSDRLNIVERKATRMSSHNVTAEDRTPVTLVGSPEDQSTVMAPQRELPA DESSKTPPLPVEDLEIHHGSNVSEDKATILSSQTVSEEDSKRSTLIRNFRRRDR FKSTEGRSPVMATQRKLPTDESGKTSSLPMEDLEIKGGLNVSEDKATSFSSRAP PREDRAHSALVRNVRKRDKFKSTNDTITVMVHQRGLSTDEASTVSVERVERRQL SNNVENPLNNLPPHSVPPTTTRGEPQYVGSESDSVNHEDVTELLLGNHEVFLST LRSRLTKLQVV | 290 | 2917 |
| 353 | WD40 repeat protein | MSTFLTGTALSNPNPNKSYEVVQPPMDSVSSLSFNPKANFLVATSWDNQVRCWE IVRSGTSLGTTPKASISHQQPVLCSTWKDDGTTVFSGGCDKQVKNWPLSGGQPM TVAMHDAPIKEISWIPEMNLLVTGSWDKTLRYWDTRQANPVHIQQLPERCYALT VRHPLMVVGTADRNLIIYNLQSPQTEFKRISSPLKYQTRCLAAFPDQQGFLVGS IEGRVGVHHLDDSQQSKNFTFKCHREGSEIYSVNSLNFHPVHHTFATAGSDGAF NFWDKDSKQRLRAMSRCSQPIPCSTFNNDGSIFAYSACYDWSKGAENHNPATAK TYIFLHLPQESEVKGRPRLGTTGRK | 148 | 1197 |
| 354 | WD40 repeat protein | MEVEAQQRDVNNVMCQLVDPEGTTLGPPMYLPQDVGPQQLQQMVNKLLSNEDKL PYTFYISDQELVVPLESYLQKNKVSVEKVLSIVYQPQAIFRIRPVNRCSATIAG HSEAVLSVAFSPDGKQLASGSGDTTVRLWDLSTQTPMFTCKGHKNWVLSIAWSP DGKHLVSGSKAGEIQCWDPLTGQPSGNPLVGHKKWITGISWEPVHLSSPCRRFV SSSKDGDARIWDVTLRRCVICLSGHTLAVTCVKWGGDGVIYTGSQDCTIKVWET SQGKLIRELKGHGHWVNSLALSTEYVLRTGAFDHTGKQYSSAEEMKQVALERYK KMKGNAPERLVSGSDDFTMFLWEPSVSKHPKTRNTGHQQLVNHVYFSPDGQWVA SASFDKSVKLWNGITGKFVAAFRGHVGPVYQISWSADSRLLLSGSKDSTLKIWD IRTKKLRRDLPGHADEVFAVDWSPDGEKVVSGGKDKVLKLWMG | 140 | 1567 |
| 355 | WD40 repeat protein | MDAGSAHSSNHKTQSRSPLQEQFLQRRNSRENLDRFIPNRSAMDFDYAHYMLT EGRKGKENPAVSSPSREAYRKQLAETLNMNRTRILAFKNKPPTPVELIPHELTS AQPAKPTKTRRYIPQTSERTLDAPDLLDDYYLNLLLDWGSSNVLSIALGNTVYLW NASDGSTSELVTIDDETGPVTSVSWAPDGRHIAVGLNNSDVQLWDSADNRLLRT LRGGHRSRVGSLAWNNHILTTGGMDGLIVNNDVRVRSHIVDTYRGHTQEVCGLK WSASGQQLASGGNDNILHIWDRSTASSNSPTQWLHRLEEHTAAVKALAWCPFQG NLLASGGGGGDRTIKFWNTHTGACLNSVDTGSQVCALLWNKNERELLSSHGFTQ NQLTLWKYPSMVKIAELTGHTSRVLFMAQSPDGCTVASAAGDETLRFWNVFGVP EVAKPAPKANPEPFAHLNRIR | 376 | 1737 |
| 356 | WD40 repeat protein | MEEAIPPFKNLPSREYQGHKKKVHSVAWNCTGTRLASGSVDQTARVWHIEPHGEG KVKDIELKGHTDSVDQLCWDPRHADLIATASGDKTVRLWDARSGKCSQQAELSG ENINITYKPDGTHVAVGNRDDELTILDVRKFKPIHKRKFNYEVNEIAWNMSGEM FFLTTGNGTVEVLAYPSLRPVDTLMAHTAGCYCIAIDPVGRYFAVGSADSLVSL WDISEMLCVRTFTKLEWPVRTISFNHTGDYVASASEDLFIDISNVQTGRTVHQI PCRAAMNSVEWNPKYNLLAYAGDDKNKYQADEGVFRIFGFESA | 69 | 1010 |
| 357 | WD40 repeat protein | MGKDEEEMRGEIEERLINEEYKVWKKNTPFLYDLVITHALEWPSLTVEWLPDRE EPPGKDYSVQKLVLGTHTSENEPNYLMLAQVQLPLEDAENDARHYDDDRADVGG FGCANGKVQIIQQINHDGEVNRARYMPQNSFIIATKTVSAEVYVFDYSKHPSKP PLDGACSPDLRLRGHSTEGYGLSWSKFKQGHLLSGSDDAQICLWDINATPKNKS LDAMQIFKVHEGVVEDVAWHLRHEYLFGSVGDDQYLLIWDLRTPSVTKPVQSVV AHQSEVNCLAFNPFNEWVVATGSTDKTVKLFDLRKISTALHTFDAHKEEVFQVG WNPKNETILASCCLGRRLMVWDLSRIDEEQTPEDAEDGPPELLFIHGGHTSKIS DFSWNTCEDWVVASVAEDNILQIWQMAENIYHDEDDVPGEESNKGS | 149 | 1423 |
| 358 | WD40 repeat protein | MMRGFSCTEDGDAPSTSSTSPPPPPPPPHRQQMQAPRASSSSSGQPTSRRSTGN VFKLLARREVSPRSKHSLKKFWGEASECQLCPFQQSYEAVRDVRRSLISWVEAF SLQHLSAKYCPLMPPPRSTIAAAFSPDCKILASTHGDHTVRLIDSQTGSCLKVL RGHRRTPWVVRFHPLYPEILASGSLDHEVHLWDANTAECIGSRNFYRPIASIAF HAQGDLLAVASGHKLYIWHYNRSGETSSPTIVLRTPRSLRAVHFHPHAAPFLLT AEVNDLDLTDSAMTLATSPGYLHYPPPTIYLADAHNSERSRLEDELPLMPSPLL MWPSFTRDDGRATLPHIGGDVGLSGQQRVDSLSSGQYEFHPSPIEPSSSTSMHE EMGTDPFSSVRESEVTQSAMNIVDNTEVQPEERSTYSFSFSDPRFWELPSVYGW LVGQTQAAPRTAPSPGALETASALGEVASVSPRSEFMPGGMDQPRLGGRSGSG CRSSGSRMMRTAGLNDHPHQENYPQSVVSKLRSELEASLAAAASTELPCTVKLR VWPYDMKDPCALFRSESCRLTIPHAVLCSEMGAHFSPCGRFFAACVACVLPQLE | 365 | 2677 |

TABLE 15-continued

Peptide Table.

| Protein SEQ ID | Target | Patent PEPTIDE Sequence | Patent ORF start | Patent ORF stop |
|---|---|---|---|---|
| | | ADPVLHGQVDPDVTGVATSPTRHPVSAYQIMYELRIYSLEEATFGMVLASRSIR AAHCLTSIQFSPTSEHLLLAYGRRHNSLLKSIVIDGENTVPIYSILEVYRVSDM ELVRVLPSAEDEVNVACFHPSVGGGLVYGTKEGKLRILQIDSSGGLNPKSTGFL DENMAEVPTYALEC | | |
| 359 | WD40 repeat protein | MGEGDLPRTEAGVLRGHEGAVLAARFNGDNYCLSCGKDRTIRLWNPHRGIHIR TYKSHGREVRDVHCTSDNSKLISCGGDRQIFYWDVSTGRVIRRFRGHDSEVNAV KFNDYASVVVSAGYDRSVRAWDCRSHSTEPIQIINTFQDSVMSVCLTKTEIIGG SVDGTVRTFDIRIGREISDDLGQPVNCISMSNDGNCILASCLDSTLRLVDRSAG ELLQEYKGHTCKSYKLDCCLTNTDAHVAGGSEDGYVFFWDLVDASVISKFRAHS SVVTSVSYHPKEDCMITASVDGTIKVWKT | 24 | 923 |
| 360 | WD40 repeat protein | MACIKGVGRSASVAMAPDGGYLATGTMAGTVDLSFSSSASLEIFGLDFQSDDRD LPLIAESPSSERFNRLSWGKNGSGSDEFSLGLIAGGLVDGTIGLWNPLSLIRSE AGDKAIVGHLSRHKGPVRGLEFNVIAPNLLASGADDGEICIWDLAAPREPSHFP PLRGSGSAAQGEISFLSWNSKVQHILASTSYNGTTVVWDLKKQKPVISFSDSVR RRCSVLQWNPDLATQLVVASDEDSSPTLRLWDMRNIMSPVKEFAGHTRGVIAMS WCPNDSSYLVTCAKDNRTICWDTVTGEIVCELPAGSNWNFDVHWYPKIPGVISA SSFDGKIGIYNVEGCSRYGVRENEFGAATLRAPKWFKRPVGASFGFGGKVVSFH TRSTGGPSVNSSEVFVHDIITEQTLVSRSSEFEAAIQSGDRPSLRALCEKKSQH CESTDDQETWGFLKVLLEDDGTARSKLLAHLGFDIPTETNDGSQEDLSQQVNAL GLEDVTADKVVQEDNNESMVFPTDNGEDFFNNLPSPRADTPVSTSADGFPTVNA AVEPSQDEVDGLEESSDPSFDDSVQRALVVGDYKAAVALCMSANRLADALVIAH VGGASLWESTRDKYLKMSRLPYLKVVFAMVNNDLQSLVDTRPLKFWKETLAILC SFAQGEEWAMLCNSLASKLMAAGNNLAATLCFICAGNIDKTVEIWSRSLATEHD GMSYMDLLQDLMEKTIVLALASGQKQFSASVCKLVEKYAEILASQGLLTTAMDY LKLLGTDDLSPELAVLRDRIAFSVEAEKGANISAFNGSQDPRGAVYGVDQSNYG MVDTSQHYYPEAAQPQVPHTVPGSPYGENYQQPFGSSFGRGYNTPMQYQAPSQA SMFVPSEPPQNAQPSFVPTPVTSQPTTRSQFIPAPPLALRNPEQYQQPTLGSHL YPGSVNPTFQPLPHAPGPVAPVPPQVSSVPGQNMPQAVAPTQMRGFMPVTNPGV VQNPGPISMQPATPIESAAAQPVVSPAAPPPTVQTADTSNVPAPQKPVIATLTR LYNETSEALGGSRANPAKKREIEDNSRKIGALFAKLNSGDISKNAADKLVQLCQ ALDNGDYSTALQIQVLLTTSEWDECNFWLATLKRNIKTRQNVRLS | 221 | 3598 |
| 361 | WD40 repeat protein | MKERGKGAGRSVDERYTQWKSLVPVLYDWLANHNLVWPSLSCRWGPQLEQATYK NRQRLYLSEQTDGSVPNTLVIANVEVVKPRVAAAEHISQFNEEARSPFVKKFKT IIHPGEVNRIRELPQNSKIVATHTDSPDVLIWDVETQPNRHAVLGASTSRPDLI LTGHKDNAEFALAMSPTEPPFVLSGGKDRYVVLWSIQDHISTLAADPGSAKSPGS AGTNNKQSSKAAGGNDKTGDSPSIEPRGVYLGHGDTVEDVTFCPSSAQEFCSVG DDSCLILWDARTGSSPAIKVEKAHHADLHCVDWNPHDVNLILTGSADNTVRMFD RRNLTSGGVGSPVHTFEGHNAAVLCVQWSPDKSSVFGSSAEDGILNIWDHEKIG RKI ETVGSKVPNSPPGLFFRHAGHRDKVVDFHWNSSDPWTIVSVSDDGESTGGG GTLQIWRMIDLIYRPEEEVLAELDKFKSHILSCTS | 44 | 1447 |
| 362 | WD40 repeat protein | MAKIAPGCEPVAGTLTPSKRREYRVTNRLQEGKRPLYAVVFNFIDSRYFNVFAT VGGNRVTVYQCLEGGVIAVLQSYIDEDKDESFYTVSWACNIDRTPFVVAGGING IIRVIDAGNEKIHRSFVGHGDSINEIRTQPLNPSLIVSASRDESVRLWNVHTGI CILIFAGAGGHRNEVLSVDFHPSDKYRIASCGMDNTVRIWSMKEFWTYVEKSFT WTDLPSKFPTKYVQFPVFIAPVHSNYVDCNRWLGDFVLSKSVDNEIVLWEPKMK EQSPGEGSVDILQKYPVPECDIWFIKFSCDFHYHSIAIGNREGKIYVWELQSSP PVLIARLSHPQSRSPIRQTAMSFDGSTILSCCEDGTIWRWDAITASTS | 196 | 1314 |
| 363 | WD40 repeat protein | MNTAMHFGAGWRSIAEMGYTMSRLEIEPESCEDEKSLDGVGNSQGPNELPRCLD HELAHLTNLKSRPHEHLIRDFPGRRALPVSTVKMLAGRECNYSRRGRFSSADCC HMLSRYVPVNGPSPLDQMNSRAYVSQFSADGSLFVAGFQGSHIRIYNVDKGWKC QKNILTKSLRWTITDTSLSPDQRYLVYASMSFIVHIVDIGSAAMDSLAMITEIH EGLDFSADSGPYSFGIFSVKFSTDGREVVAGSSDDSIYVYDLVANKLSLRIPAH ESDVNTVCFADESGHIIYSGSDDTYCKVWDRRCLSARNKPAGVLMGHLEGITFI DSRGDGRYFISNGKDQTIKLWDIRKMGSDICRRGFRNFEWDYRWMDYPPRARDS KHPFDLSVATYKGHSVLRTLIRCYFSPVHSTGQKYIYTGSHDSCVYIYDVVTGA QVAALKHHKSPVRDCSWHPEYPMIVSSSWDGDIVKWEFFGNGETEIPANKKRIR RRHLY | 193 | 1668 |
| 364 | WD40 repeat protein | MEFQPQAPKKRGRKPKPKEDKKEEQLHQPPPPPPPQQQAAPAPAPAATRSSTSG SAGGRDRRPQQQHAVDEKYARWKSLVPVLYDWLANHNLLWPSLSCRWGPQLEQA TYKNRQRLYISEQTDGSVPNTLVIANCEVVKPRVAAAEHVSQFNEEARSPFIRK YKTIIEPGEVNRVRELPQNPNIVATHTDSPDVLIWDVESQFNRHAVYGATASRP NLILTGHQENAEFALAMCPAEPPFVLSGGKDKTVVLWSIQDHITASATDQTTNKS PGSGGSIIKKTGEGNEETGNGPSVGPRGIYCGHEDTVEDVAFCPSTAQEFCSVG DDSCGLILWDARVGTNPVAKVEKAHNGDLHCVDWNPHDNNLILTGSADNSVNNFD RRNLTSNGVGSPVYKFEGHKAAVLCVQWSPDKPSVFGSSAEDGLLNIWDYERVD KKVDRAPNAPAGLFFQHAGHRDKIVDFHWNAADPWTMVSVSDDCDTAGGGGTLQ IWRMSDLIYRPEEEVLAELENFKAHVLECSKA | 78 | 1634 |

TABLE 15-continued

Peptide Table.

| Protein SEQ ID | Target | Patent PEPTIDE Sequence | Patent ORF start | Patent ORF stop |
|---|---|---|---|---|
| 365 | WD40 repeat protein | MGIFEPYRAVGYITTGVPFSVQRLGTETFVTVSVGKAFQVYNCAKLSLVLVGPQ LPKKIRALASYREYTFAAYGSDIGIFKRAHQLATWSGHTAKVCLLLLFGEHILS VDVDGNAYIWAFKGMNYNLSPVGHILLDSNFTPSCIMHPDTYLNKVILGSQEGP LQLWNISTKTKLYEFKGWNSSVSSCVSSPALDVVAVGCADGKIHVHNIRYDEEL VTFSHSMRGSVTALSFSTDGQFLLASGSSSGVVSIWNLDKRRLQSVIRDAHDGS IISLHFFANEPVLMSSSADNSIRMWIFDTSDGDPRLLRFRSGHSAPPLCIRFYA NGRHILSAGQDRAFRLFSVVQDQQSRELSQRHVSRRAKKLELKEEEIKLKPVIA FDVAEIRERDWCNVVTSHMDTPQAYVWRLQNFVIGEHILRPCPNKPTFVKACMI SACGNFAILGTAGGWIERFNLQSGISRGSYIDQLEGTNSAHDGEVVGVACDATN TLMISAGYAGDIKVWDFEGRELKSRWEIGSSLVKISYHRLNGLLATVADDFIIR LFDAVALRMVRRFEGHTDRITDLCFSEDGKWLLSSSMDGSLRIWDIILARQVDA VFVDVSITALSLSPNMDILATTHVDQNGVFLWVNQSMFSGDSDINLYASGKEVV TVKLPSVSSVEGSQVEESNEPTIRHSESKDVPSFRPSLEQIPDLVTLSLLFKSQ WQSLINLDIIKVRNRPVEPPKKFEKAPFFLPSIPSLSGEILFKPSEMSDKGDMK ADEDKSKITPEVPSSRFLQLLHSCSEARNFSPFTTYIKGLSPSTLDLELRMLQI IDDDAVDADADDPQDVDKRQELLSIELLMDYFIHEISCRSNFEFVQALVRLFLK IHGETIRRQSVLQNKAKVLLETQCSVWQRVDKLFQGARCMVAFLSNSQF | 85 | 2826 |
| 366 | WD40 repeat protein | MEETKVTCGSWIRRPENVNLAVLGRSPRRRGSAALEIFAFDPKSTSLSSSPLVA HVIEEIEGDPLAIAVHPNGEDIVCFASSGSCLSFELSGQESNLKLLTKELPPLR GIGPQKCMAFSVDGSRFATGGVDGRLRILEWPSLRIILDEPRAHKSIRDLDFSL DSEFLATTSTDGSARIWKAEDGLPCTTLTRRSDEKIELCRFSKDGTRPFLFCTV QRGDKAVTGVWDISTWNKIGHKRLLRRPAVVMSISLDGKYLAQGSKDGDMCVVE VKKNEVSHWSKRLHLGTSLTSLEFCPIERVVITTSDEWGVLVTKLNVPADWKAW QVYLLLLGLFLASLVAFYIFYENSDSFWGFPLGKDQPARPKIGSVLGDPKSADD QNMWGEFGPLDM | 74 | 1246 |
| 367 | WD40 repeat protein | MADPVEHQHQQHQQHQLQQQRRRGWRIQGGQYLGEISALCFLHLPPPPLSLSSS PVLSLSSGLDSESRDRFACSFRFPSAGSGSQVSLFDLASGAMVRTFYVFRGIRV HGIVLGCADFPGGSSSSSSTLDYVIAVYGERRVKLFRLSVRLGRGAGEGSGTVL SADLELVSAAPRLSHWVMDVRFLKENGTSEDELQRCLTVAIGCSDNSIRLWDVD KCSFVLAVSSPERCLLYSMRLWGDNLEDLQVASGTIYNEILIWKVVPNHDAPSS NELTEEGLTNSCAGNSVHECLRYEAYHICRLVGHEGSIFRIAWSSDGSKLVSVS DDRSARIWEVHCRVQYSEDAGEVGLLFGHSARVWDCYISDNLIVTAGEDCSCRV WGLDGQQHDVIKEHIGRGIWRCLYDPWSSLLVTGGFDSAIKVHKLDASLAEASA KQSNIKDLSDGTELFTTHLPNSSGHSGHMDSKSEYVRCLSFSCEDVMYIATNHG YLYHAKLCNDGDLRWTELAQVSNEVQIICMELLPSNPYDPRIDADDWVAVGDGR GWTTVVRVVKNSDSPKVSTSFSWAAEMDRQLLGIHWCKSLGHRFIFTADPRGAL KLWRFFEVSQSSSLYPENSFRISLIAEFKSDLGARIMCLDVAFESELLICGDLR GNLVLFPLLKDLLLDTFVVSAAKISPVNHFKGAHGISAVSSISVAHNSFNHIEL RSTGADGCICYMEYDKGLQSLNFVGMKQVKELSMIESVSTENESTGYRTSGSYA SGFASTDFIIWNLVTEAKVLQVSCGGWRRPHSYYLGDVPEMKNCFAYVKDDIIY IRRHWIKDSKDKILPQNLRLQFHGREVHSLCFVTGDFQLRKNKQSSSWIVTGCED GTVRLTRYTQCTDNWSSSKLLGEHVGGSAVRSICCVSNIHTTSSGTSVSDVKGI ENLPKDIRGTLMEDECNPSLLISVGAKRVLTSWLLRRRKQDGKEDDVTDLQEAE NSSLPSSAGSSTFSFQWLSTDMPVKYSVPSRKSGSIKKLIGVSDTNVRCKSLLP DSEALQSKVSAVDKNEDDWRYLAVTAFLVRHSGSRLIVCFIIVACSDATLAIRA LVLPYRLWFDVALMVPLSSPVLSLQHVIIGRCQLPDENVQIGNVYVVISGATDG SIAFWDLTESVEAFMRRLSNIHLEKFMDCQKRFRTGRGSQGGRWWRSLSKIACK EQPINDPVTAKAIKELNRKLTGGVACGSSSSMLDASPELDSNAANSSFEIIEVN PFHVLNGVHQSGVNCLHVCETKHGQSSDGRFLYQLVSGGDDQALHLLKFEVLVQ PPVQVFDVPNSDIRNSILVEEFLLDEQNQKTKCTIEFISQEKIASAHNSAVKGV WTDGTWVFSTGLDQRVRCWISKDRGTPTELAHFIISVPEPEALDARSICWDQYQ IAVAGRGMQMIEFHVPSSEIR | 100 | 4377 |
| 368 | WD40 repeat protein | MPYKLSATLSNHSSDVRAVASPSDDLILSASRDSTAISWFRQSPSSFTPASVIR AGSRFVNAIAYLPPTPRAPQGYAVVGGQDTVVNVFALGPGDKEEPEYTLVGHTD NVCALSVNSDDTIISGSWDKTAKVWKDFALVYDLKGHQQSVWAVLAMNEKEFLT ASADRTIKYWVQHKTMQTYEGHRDAVRGLALIPDIGFASCSNDSEIRVWTMGGD VVYTLSGHTSFVYSLSVLPNGDLVSAGEDRSVRVWRDGECSQVIVHPAISVWAV STMPNGDIISGSSDGVVRVFSESEKRWATASELKALEDQIASQSLPSQQVGDVK KTDLPGPEALSVPGKKAGEVKMIRSGDVVEAHQWDSLASSWQKIGEVVDAIGSG RKQLHDGKEYDYVFDVDIQEGAPPLKLPYNVSENPYTAAQRFLEQNDLPTGYLD QVVKFIEQNTAGVKLGNDGYVDPPFTGASRYQPATQSTSNTASSSYMDPFTGGSR HIAESAPSNVPQGSHATGIIPFSKPIFFKLANVSANQAKMFQFDEVLRNEISTA TLANRPDEVIMVNETFTYLSKVVTSTSSARTSLGWIHIETIMQILDRWPVPQRF PVIDLGRLVTAYCMNAFSGPGDLEKFFSCLFRTSEWTSITSGSKALTKAQETNV LLLERTIANSLDGAPLNDMEWIKQIFRELAQTPQLVLNKSHRLALASVLFNFSC IGLKGPVPADVRTLHLTIILQVLRSPNDDPEVAYRTCVALGNMLYSDKTRGTPR DAQSPSPTELKSAVAAIKGGFSDPRINDVHREIMSLI | 58 | 2439 |

US 7,598,084 B2
223                                                                                         224

TABLE 15-continued

Peptide Table.

| Protein SEQ ID | Target | Patent PEPTIDE Sequence | Patent ORF start | Patent ORF stop |
|---|---|---|---|---|
| 369 | WD40 repeat protein | MPPQKIESGHKDTVHDLAMDYYGKRLATASSDHTINVVGVSSSGSQHLATLIGH QGPVWQISWAHPKFGSLLASCSYDGRVIIWREGNPNEWTQAQVFEEHKSSVNSV AWAPHELGLCLACGSSDGNISVFTARQDGGWDTSRIDQAHPVGVTSVSWAPSTA PGALVGSGMMEPVQKLCSGGCDNTVKVWKLYNRVWKLDCFPVLQMHTDWVRDVA WAPNLGLPKSTIASASASQDGRVIIWTLAKEGDQWQGKVLYDFRTPVWRVSWSLTG NILAVADGNNNVSLWNEAVDGEWIQVSTVEP | 159 | 1064 |
| 370 | WD40 repeat protein | MSAPMLEIEARDVVKIVLQFCKENSLHQTFQTLQSECQVSLNTVDSIETFVADI NSGRWDAILPQVAQLKLPRNTLEDLYEQIVLEMIELRELDTARAILRQTQAMGV MKQEQPERYLRLEHLLVRTYFDPNEAYQDSThEKRRAQIAQALAAEVTVVPPSR LMALVGQALKWQQHQGLLPPGTQFDLFRGTAAMKQDVDDMYPTTLSHTIKFGTK SHAECARFSPDGQFLVSCSVDGFIEVWDYMSGKLKKDLQYQADETFMMHDDPVL CVDFSRDSEMLASGSQDGKIKVWRIRTGQCLRRLERAHSQGVTSVLFSRDGSQL LSTSFDGSARIHGLKSGKQLKEFRGHSSYVNDAIFSNDCSRVITASSDCTVKVW DVKTSDCLQTFKPPPPLRGGDASVNSVHLFPKNADHIVVCNKTSSIYIMTLQGQ VVKSLSSGKREGGDFVAACVSPKGEWIYCVGEDRNLYCFSCQSGKLEHLMKVHE KDVIGVTHHPHRNLVATYSEDSTMKLWKP | 118 | 1665 |
| 371 | WD40 repeat protein | MDLLQSYAEDNDGDLGRHSSPEPSPPRLLPSKSAAPKVDDTTLALTVAQTNQTL ARPIDPSQHAVAFNPTYDQLWAPICGPAHPYAKDGIAQGMRNHKLGFVEDAAIG SFLFDEQYNTFQRYGYAADPCASTGNEYVGDLDALKQNDGISVYNIRQQEQKKY AEEYAKKKGEERGEGGREKAEVVSDKSTFHGKEERDYQGRSWIAPPKDAKATND HCYIPKRLVHTWSGHTKGVSAIRFFPKHGHLILSAGMDTKVKIWDVFNSGKCMR TYMGHSKAVRDISFCNDGTKFLTAGYDKNIKYWDTETGKVISTFSTGKIPYVVK LHPDDEKQNILLAGMSDKKIVQWDMNTGQITQEYDQHLGAVNTITFVDDNRRFV TSSDDKSLRVWEFGIPVVIKYISEPHMMSMPSISLHPNTNWLAAQSLDNQILIY STRERFQLNKKKRFAGHIVAGYACQVNFSPDGRFVMSGDGEGRCWFWDWKSCKV FRTLKCHEGVCIGCEWHPLEQSKVATCGWDGLIKYWD | 57 | 1628 |
| 372 | WD40 repeat protein | MESNGNLEQTLQDGRIYRQLNSLIVAHLRDHNFPQAASAVALATMTPLNVEAPR NRLLELVARGLAVEKGELLRGVSHAGTNDLGGSIPASYGLVPAPWTAIDFSSLR DTKGMSKSFTKHETRHLSDHKNVARCARFSTDGRFFATGSADTSIKLFEVSKIK QMNLPDSTDGAIRAVIRTFYDHTHPVNDLDFHPQNTVLISAAKDHTVKFFDYSK ATAKRAFRVIQDTHNVRSVAFHPSGDFLLAGTDHPIPELYDVNTFQCYLSANVP EFAVNAAINQVRYSSSGGMYVTASKDGTIRFWDGASANCVRSIAGAHGAAEVTS ANFTKDQRYVLSCGKDSTVELWEVGTGRLVKQYLGATHNQLRCQAVFNNTEEFV LSIDEPSNEIVVWDAMTAEKVARWPSNHNGPPRWIEHSPTEAAFVSCGTDRSIR EWEETH | 250 | 1566 |
| 373 | WD40 repeat protein | MSNFQGEDGEYVADDFEAEDGDEELHGRESADPESDVDEIDTPSNRFTDTTADQ ARRGRDIQGIPWERLSITREKYRRTRLEQYKNYENVPQSGEKSGKDCTVTEKGN SFYEFRRNSRSVKSTILHFQLRNLVWATSKHDVYLMSNYSVVHWSSLTGKKSEV LNLAGHVAPNEKHPGSLLEGFTQTQVSTLAVKDRFLVAGGFQGELICKFLDRPG ISFCSRTTYDDNAITNAVEIYVSPSGGIHFIASNNDCGVRDFDMENFELSRHFR FPWPVNHTSLSPDGKLLVIVGDDPEGILVDAKTGKTINPLRGHLDFSFASEWHP DGVTFATGNQDKTCRIWDIRNLSKSIAVLKGNLGAIRSIRYTSDGRYMAIAEPA DFVHVYDTKTGYKKEQEIDFFGEISGMSFSPDTESLFIGVWDRTYGSLLEYGRR RNFSYLDCLV | 106 | 1434 |
| 374 | WD40 repeat protein | MGVEEDLEDLNALAESTDAAVDGQAALASAVDSVTLQPAPPILPPVIPPPAVPV VAPVPTIPPVLRPLAPLPIRPPVLRPPAPKRDEAGSSDSDSQHDGTAAGSTAEY EITEESRLVRERHEKAMQDLNMKRRGAALAVPTNDKAVRARLRRLGEPMTLFGE REMERRDRLRMLMAKLDAEGQLEKLMKAHEDEEAAASAAPEDVEEEMLQYPPFYT EGSKALFNARIDIARFSITRAALRLERARRRRDDPDEDVDAEIDWALKKAESLS LHCSEIGDDRPLSGCSFSHDGRLLATCSMSGVAKLWDTCRNPQVNRVLTLKGHT ERATDVAFSPVQNHIATASADRTARLWNTEGTILKTFEGHLDRLGRIAFHPSGK YLGTTSFDKTWRLWDIESGEELLLQEGHSRSIYGIDFHRDGSLVASCGLDALAR VWDLRTGRSILALEGHVKPVLGVSFSPNGYHLATGGEDNTCRIWDLRKKKSLYT IPAHANLISEVRFEPQEGYFLVTASYDTTAKVWSARDFKPVRTLSVHEAKITSV DITADASHIVTVSHDRTIRLWTSNDDVKEQAMDVD | 190 | 1917 |
| 375 | WD40 repeat protein | MVKAYLRYEPAAAFGVIASVESNIAYDASGRHLLAPALERVGVWHVRQGVCTRA LAPSSASSAAGPSLAVTAIASSPSSLIASGYADGSIRIWDFEKGSCETTLNGHKG AVSVLRYGKLGSLLASGSRDNDIILWDVVGETGLYRLRGHRDQVTDLVFLDSDR KLVSSSKDKYLRVWDLETQHCMQIVGGHHSEIWSLDTDPEERYLVTGSADPELR FYTVKNDSSDERSEADASGGVGNGDLASHNKWDVLKQFGEIQRQSKDRVATVRF NKNGNLLACQAAGKLVEVFRVLDEAEAKRRARRRLHRKREKRGADVNENGDSSR GIGEGHDTMVTVADVFRLLQTIRASKRICSISFCPVAPKSSLATLALSLNNNLL EFHSIEADKTSKMLTIELQGHRSDVRSVTLSSDNTLLMSTSHNSVKIWNPSTGS CLRTIDSGYGLCGLIVPQNKHALIGTKDGAIEIFDVGSGTCIEVVEAHGGSIRS IVAIPNQNGFVTGSADHDIKFWEYGMRKPGDNSKHLTVSNVRTLKMNDDVLVV AVSPDAQKIAVALLDCTVRVFFMDSLKLMHSLYGHRLPVLCLDISSDGDLIVTG | 102 | 2942 |

TABLE 15-continued

Peptide Table.

| Protein SEQ ID | Target | Patent PEPTIDE Sequence | Patent ORF start | Patent ORF stop |
|---|---|---|---|---|
| | | SADKNLMIWGLDFGDRHKSIFAHGDSIMAVQFVGNTHYMFSVGKDRLVKYWDAD KFELLLTLEGHHADIWCLAISNRGDFLVTGSHDRSIRRWDRTEEPFFIEREKEK RLEEMFESDLDNAFGNKYVPKEEIPEEGAVALAGKKTQETLSATDSIIEALDIA EVELKRIAEHEEEKNNGKTAEFHPNYVMLGLSPSDFILRALSNVQTNDLEQTLL ALPFSDALKLLSYLKDWTTYPDKVELVSRIATVLLQTHYNQLVSTPAARPLLTT LEDILHKKVKECKDTIGFNLAAMDHLKQLMALRSDALFQDAKVKLLEIRSQLSK RLEEERTDPREAKRRKKKQKKSTNMHAWP | | |
| 376 | WD40 repeat protein | MGGVQAEREDKDKVSLELTEEILQSMEVGMTFRDYSGRISSMDFHRASSYLVTA SQDESIRLYDVASATCLKTINSKKYGVDLVSFTSHPMTVIYSSKNGWDESLRLL SLHDNKYLRYFKGHHDRVVSLSLCPRNECFISGSLDRTVLLWDQRAEKCQGLLR VQGRFATAYDDPGLVFAIAFGGCVR4FDARKYEKGFFEISVGGDVSDANVVKF SNDGRLMLLTTTDGHIHVLDSFRGTLLYTFNVKPTSSKSTLEASFSPEGMEVIS GSGDGSVYAWSVRGGKEVASWLSTDTEPPVIKWAPGNLMFATGSSELSEWIPQL SKLGAYVGRK | 75 | 1079 |
| 377 | WD40 repeat protein | MAAFGAAPAGNHNPWKSSEVIQPPSDSVSSLCFSPRANHLVATSWDNQVRCWEL TKNGASVTSVPKASMSHDQPVLCSAWKDDGTTVFSGGCDKQAKMWSLMSGGQPV TVAMHDAPIKEIAWIPEMNVLVTGSWDKTLKYWDTRQSNPVHTQQLPERCYANT VRYPLMVVGTADRNLIVENLQNPQAEFKRFSSPLKYQTRCVAAFPDQQGFLVGS IEGRVGVHHLDDSQISKNFTFKCHRDNNDIYSVNSLNFHPVHHTFATAGSDGTF NFWDKDSKQRLKAMSRCSQPIPCSTFWNDGTIYAYSVCYDWSKGAENHNPATAK TYIFLHLPQESEVKAKPRVGTTNRK | 99 | 1148 |
| 378 | WD40 repeat protein | MNCSISGEVPEEPVVSTKSGHVFERRLIERYVSDYGKCPVSGEPLTMDDVLPVK MGKIVKPRPLQAASIPGLLSIFQNEWDSLMLSWFALEQQLHTARQELSHALYQH DAACRVIARLKKERDEARSLLALAERQIPMTASSDIAVWAPAMSNGRKASLDEE PGYAGKKMRPGISASIIAEITDCNLALSQQRRKRQIPSTLAPVEDLERYTQLSS YPLHKTGKPGITSLDICHSKDIIATGGIDTSAVLFDRSSGQIMSTLSGHSKKVT SVWFDAQGDMVLTGSADKTVRIWQGSEDGSYNCRHILKDHTAEVQAITVHATNN YFATASLDWTWCFYEFSTGLCLTQVEGASGSEGYTSAAFHPDGLILGTGTSNAD VKIWDVKTQANVTTFSGHTGAITAISFSENGYFLATAAQDGVKLWDLRKLKNFR TFSAYDKDTGTNSVEFDHSGCYLGLAGSDIRVYQVASVKSEWNCVKTFPDLSGT GKVTCVKFGPDSKYIAVGSMDHWLRIFGLPSEDGANES | 232 | 1806 |
| 379 | WD40 repeat protein | MAAPGVETLKKEIKELKEKIAQHRLDTDGEQPLPAAAKSKSVPEVSAALRQRRI LKGHFGKIYALHWSADSRHLVSASQDGKLIIWNGFTTNKVHAIPLRSSWVMTCA YSPSGNLVACGGLDNLCSVYKVPHGGNKESSSAQKTYGELAQHEGYLSCCRFIK DNEIVTSSGDSTCILWDVETKTPKAIFNDHTGDVMSLAVFDDKGVFVSGSCDAT AKLWDHRVHRQCVMTFQGHESDINSVQFFPDGDAFGTGSDDSSCRLFDIRAYQQ INKYSSQKILCGITSVAFSKTGKSLFAGYDDYMTYVWDTLSGNQVEVLTGHENR VSCLGVSEDGKALATGSWDTLLKIWA | 72 | 1124 |
| | | MGGVEDESEPASKRNKLSSRVLRGLANGSSRTEPAAGSSLDLMARPLPIEGDES VIGSKGVIKRVEFVRLIAKALYSLGYEKSGARLEEESGIPLQSSVVNLFMQQIS DGLWDESVVTLHKIGLSDENLVKSASFLILEQKFLELLDQEKANDALKTLRTEI TPLCIKNSRVRELSSCIISPSSCGLLNQNKRNSTRARSRSELLEELQKLLPPAV IIPERRLEHLVEQALVLQTDACMLHNSIDMEMSLYTDHQCGKEHIPCRTLQILQ SENDEVMLVQFSHNGKYLASASNDRSAIIWEVDENGSVSLKHKLTGHQKPISSV CWSPDDRQLLTCGVGETVRRWDVSSGECLRVYEKAGHGLISCAWFPDGKWICYG VSDRSICMCDLEGKEIECWKGQRTLSISDLEITSDGKQIISICRETAILLLDRE AKYERMIEENQTITSFSLSKDNRYLLVMLLNQEIHLWDIKGDFRLVAKYKGLKR SRFVIRSCFGGLKQAFVASGSEDSQVYIWHKGSGELIEPLPGHGSGAVNCVSWNP ANHHMLASASDDRTIRIWGLMELNTRHKGARPNGVHYCNGNGTS | 315 | 2069 |
| 381 | WD40 repeat protein | MTQLAETYACMPSTERGRGILIAGNPKPGSNSVLYTNGRSVVILNLDNPLDISV YAEHAYPATVARFSPNGEWVASADSSGAVRIWGAYNDHVLKKEFKVLSGRIDDL QWSPDGLRIVASGDGKGKSLVRAFMWDSGTNVGEFDGHSRRVLSCAFKPTRPFR IVTCGEDFLVNFYEGPPPFKFKLSRRDHSNFVNCLRFSPDGNRFISVSSDKKGII YDGKTGEKIGELSSDGGHTGSIYAVSWSPDSKQVITVSADKSAKIIWISEDGSG NLRKTLTSSGSGGVDDMLVGCLWQNNHLVTVSLGGTISIYTAGDLDKAPVSFSG HMKNVSSLSVLKGDPKVILSSSYDGLIIKWIQGIGFSGRVQRKESTQIKCLAAV DEEIVTSGYDNKVCRVSGSGDAEFIDIGCQPKDLSLALQCPEFALVSTDTGVVL LRGAKIVSTINLGFAVTASTVAPDGTEAIIGAQDGKLRIYSISGDTLTEEAVLE KHRGAISVIHYSPDLSMFASGDLNREAVVWDRASREVRLKNILYHTARINCLAW SPDSSTVATGSLDTCVIIYEVDKPASNRLTIKGAHLGGVYGLAFTDDFSVVSSG EDACIRVWKINRQ | | |
| 382 | WD40 repeat protein | MKVKVISRSTDEFTRERSQDLQRVFRNFDPNLRTQEKAVEYVRALNAAKLDKVF ARPFVGAMDGHVDSVSCMAKNPNYLKGIFSGSMDGDIRLWDIASRRTVCQFPGH QGPVRGLAASTQGQILVSCGIDSTVRLWNPVATLGESDGTHENLAKPLAVYVW KNAFWAVDHQWDGELFATAGAQVDIWNQNRSQPISSFEWGTQTVISVRFNPGEP NVLATSGSDRSITLYDLRMSSPTRKVIMRTKTNAISWNPMEPMNFTAANEDCNC YSYDARKLEEAKCVHKDHVSAVMDIDYSPTGREFVTGSYDRTVRIFQYNGGHSR | 130 | 1488 |

TABLE 15-continued

Peptide Table.

| Protein SEQ ID | Target | Patent PEPTIDE Sequence | Patent ORF start | Patent ORF stop |
|---|---|---|---|---|
| | | EVYHTKRMQRVFCVKFSCDASYVISGSDDTNLRLWKAKASEQLGVVLPRERRKH EYHEAVKSRYKHLPEVKRIVRHRHLPKPIYKAGILRRTVNEADRRKEERRKAHS APGSSSAEPLRKRRIIKEIE | | |
| 383 | WD40 repeat protein | MVRSIKNPKKAKRKNKGSKNGDGSSSSSSIPSNPTKVWQPGVDKLEEGEELQCD PSAYNSLHAFHIGWPCLSFDIVRQTLGLVRTEFPHQVYFVAGTQAEKPTWNSIG IFKVSNITGKRRELVPSEPTDDADEESDSSDSDEDSDDEVGGSGTPILQLRKVG HEGCVNRIRAMNQNPHICASWGDSGHVQIWDFSSHLNALAESEADVSQGASSVF NQAPLVKFGGHKDEGYALDWSPLVPGRLVSGDCKNSIHLWEPTSGSTWNVDSTF FIGHAASVEDLQWSPTEENVFASCSVDGTIAIWDTRLGKTPAASFKAHDADVNV ISWNRLATCMLASGCDDGTFSIHDLRLLKEGDSVVAHFEYHKHPVTSIENSPEE ASTLAVSSADCQLTIWDLSLEKDEEEEAEFKAKTKEQVNAPEDLPPQLLFVHQG QKDLKELHWHAQIPGMIVSTAADGFNILNPSNIQSTLPSDGA | 269 | 1693 |
| 384 | CDK type A | MERYKVIKELGDTYGSVWKALNQQTHEIVAIKKMKRKYYIWEECINLREVKSL RKLNHPNIIKLKEVIRENNELFFIFEYMECNLYQIMKERSTPFSETAIIKFCYQ ILQGLSYMHRNGYFHRDLKPENLLVTSDLIEIADFGLAREVLTSPPYTDYVSTR WYRAPEVLLQSPTYTTAIDMWAVGAILAELFTLHPLFPGESELDEIYKICGVLG TPDYETWPDGMQLAAFRNFIFPQFLPVNLSVLIPHASPEAIDLITRLCSWDPQK RPTAEQALHHPFFRIGMSIPLSLGGHFQDNTCAAEVDTNFHSKKACKGRGNGEK ESSLECFLGLSLGLKPSLGHLGAMGSQGVGAVKQEVGSSPGCQSNPKQSLFQVL NSBAILPLFSSSPNLNVVPVKSSLPSAYTVNSQVNWPTIAGPPAAAVTVSTLQP SILGDFKIFGKSMGLASQYAGKEASPFS | 1163 | 2545 |
| 385 | CDK type A | MGEMGRGINNSSNNNNSNRPAWLQHYDLVGKIGEGTYGLVFLARSKLPNNRGLR IAIKKFKQSKDGDGVSPTAIREIMLLREFSHENVVKLVNVHINHVDMSLYLAFD YAEHDLYEIIRHHREKLNHHNINQYTVKSLLWQLLNGLNYLHSNWIVHRDLKPS NILVMGEGEEHGVVKIADFGLARIYQAPLKPLSDNGVVVTIWYBAPELLLGAKH YTSAVDMWAVGCIFAELITLKPLFQGVEVEASPNPFQLDQLDKIFKVLGHPTIE KWPTLMNLPHWSKNLQQIQQHKYDNAGLHIGPIPAKSPAYDLLSKMLEYDPRKR ITAAQALEHEYFRIDPQPGRNALVPSQPGEKAINYPPRLVDANTDFDGTIAPQP SQVSSGNAPSGSIASAAVPAVRPLPQQMQLMGMQRMQNPGMAAFNLGAQASNSG LNHNNIALQRGSSQQQAHQQVRRKEPNSGFPNTGYPPPPRSRRL | 152 | 1582 |
| 386 | CDK type B-1 | MDKYEKLEKVGEGTYGKVYARDKMTGQLVALKKTRLEMDEEGVPPSSLREISL LQMLSQSIYVVRLLCVEHVTKKGKPLLYLVFEYLDTDLKKFIDYRRSVNAGPLP QNVIQSEMYQLLKGVAHCHSHGVLHRDLKPQNLLVDKSKGLLKVGDLGLGRAFT VPLKCYTHEVVTLWYRAPEVLLGSTHYSTPVDIWSVGCIFAEMVRRQPLFPGDC EIQQLLHIFTLLGTPTEEMWPGVKRLRDWHEYPQWKPENLAPAVPNLSPTGLDL ISKMLQCDPAKRISAEAAMNHPYFDDLDKSQF; | 389 | 1297 |
| 387 | CDK type B-1 | MDGYEEMDKVGEGTYGKVYMARDKKTGQLVALKKTRLENDGEGIPPTALREISL LQMLSQDIYIVRLLDVKHTENKLGKPLLYLVFEYMESDLKKYIDSYRRSHTRNP PSMIKSFMYQLCRGVAYCHSRGVMHRDLKPHNLLVDKEKGVLKIADLGLSBAFT VPVKKYTHEIVTLWYRAPEVLLGATHYSLPVDIWSVGCIFAEMSRMQALFTGDS EVQQLNNIFRFLGTPNEEVWPGVTKLKDWHIYPEWKPQDISHAVPDLEPSGLDL LSQMLVYEPSKRISAKKALEHPYFDDLDKSQF | 38 | 946 |
| 388 | CDK type B-1 | MDAYEKLEKVGEGTYGKVYKAKDKNTGQLVALKKTRLESDDEGIPPTALREISL LQMLSQDIHIVRLLDVEHTENKNGKPLLYLVFEYMDSDLKKYIDGYRRSHTKVP PKIIKSFMYQLCQGVAYCHSRGVMHRDLKPHNLLVDKQRGVVKIADLGLGRAFT IPIKKYTHEIVTLWYRAPEVLLGATHYSTPVDIWSVGCIFAEMVRLQALFIGDS EVQQLFRIFSFLGTPNEEIWPGVTKFRDWHIYPQWKPQDISSAVPDLEPSGVDL LSKMLVYEPSKRISAKKALEHPYFDDLDKSQF | 180 | 1088 |
| 389 | CDK type B-1 | MDSYEKLEKVGEGTYGKVYKAKDKKTGKLVALKRTRLENDGEGIPPTALREISL LQMLSQDMNIVRLLDVEHTENKNGKPLLYLVFEYMDSDLKKYVDGYRRSHTKMP PKIIKSFMYQLCQGVAYCHSRGVMHRDLKPHNLLVDKQRGVLKIADLGLGRAFT VPIKKYTHEIVTLWYRAPEVLLGATHYSTPVDIWSVGCIFAEMSRMHALFCGDS EVQQLMSIPKFLGTPNEGVWPGVTKLKDWHIYPEWRPQDLSRAVPDLEPSGVDL LTKMLVYEPSKRISAKKALQHPYFDDLDKSQF | 40 | 948 |
| 390 | CDK type B-1 | MEKYEKLEKVGEGTYGKVYKGRDKRTGRLVALKKTPFHQEEGIPPTAIREISLL KSLSQCIYIVKLLDVKASFNGKGKHVLFNVFEYADSDLEKHIDAHRQCNTRLSP RSIQSYMFQLCKGIAYCHSHGVLHRDLKPQNILVDQKIGLLEIADLGLGRACTV PIKSYTFEVVTLWYRAPEVLLGAKRYSMALDIWSLGCIFAELCNLQALFGADSQ IQQLINIFRLLGTPNEQLWPGVTQLSDWHEFPQWRPQQLSKVVFNLDPNGVDLL SKMLQYDPAKRISAKEALDHPYFQSLDKSQF | 229 | 1134 |
| 391 | CDK type C | MGCVCGKPSARAADYVESPAEKGASSNSRSSSMASRRLVAPAVMDQGIDAENGH EGDYRTKLRGKQSNGADPVSLLSDDAEKQRHSRHHQHQQHHPIRPHHLRPQGEF VPNANSNPRFGNPPRHIEGEQVAAGWPAWLTAVAGEAIEGWIPRRADSFEELDIC IGQGTYSNVYKARDLDTGKIVALKKVRFDNLEPESVRFMAREIQVLRRLDHPNV | 105 | 2642 |

TABLE 15-continued

Peptide Table.

| Protein SEQ ID | Target | Patent PEPTIDE Sequence | Patent ORF start | Patent ORF stop |
|---|---|---|---|---|
| | | VKLEGLVTSRMSCSLYLVFEYMDHDLAGLAACPGIRFTEPQVKCYMQQLLRGLD HCHSRGVLHRDIKGSNLLIDNGGILKIADFGLATFFHPDQRQPLTSRVVTLWYR PPELLLGATEYGVAVDLWSTGCILAELLAGRPIMPGRTEVEQLHKIFKLCGSPS EDYWKKSRLPHATIFKPQQPYKRCVAETFKDFPPSALALMEVLLAIEPADRGTA TSALKSDFFTTKPLACDPSSLPRYPPSKEFDAKIRDEEARRQRAAGGRGRDAAR RPSRESRAIPAPEANAELAISIQKRRLSSQGPSKSKSEKFNPQQEDGAVGFPIE PPRPMHIGIDAGATSRMYSQQFGPSHSGPLSNQISSSIWGENQKEDEIQMAPGR PSRSSKATISDFRRPGACAPQPGADLSHLSSLVATARSNAGIDTHKDRSGMWQH NRIDAIDGVHNNGKHEFLEVPEHPNRQDWTRFQQPESFKGLDNYHLQDLPATHH RKDERVASKEATMNWQGYGGQGGDKIHYSGPLLPPSGNIDEILKEHERHIQHAV RRARQDKGRPQRSNLSQNEREAFEHRSFVSGVNGNAGYSDLVNELPISVGSNRL RVSRTRGTEEIVELRELEREPLSSVMEKYEREHEM | | |
| 392 | CDK type C | MGCVCAKQSDILGEPESPKVKGSNLASSRWSVSSETKQLPQHSDSGILHHQHYY HPRDESDEAKLKESNYGGSKRRTRQGRDPADLDMGIFVRTPSSQSEAELVAAGW PAWMAAFAGEAIHGWIPRRAESFERLYRIGQGTYSNVYKARDLDNGRIVALKKV RFDSLDAESVRFMAREILVLRKLDHPNIVKLEGLVTSEVSSSLYLVFEYMEHDL AGLAACPGIKFTEPQVKCYMQQLLQGLDHCHRHGVLHRDIKGSNLLIDNGGILR IADFGLATFFYPDQKQLLTSRVVTLWYRPPELLLGATDYGVAVDIWSAGCILAE LLAGKPILPGRTEVEQLHKIFKLCGSPSEDYWKESKLPHATIFKPQHPYKSCIA EAFKDFSPSALALLETLLAIEPGHRGEASGALKSEFFTTEPLSCDPSSLPKYPP SREFDAKLRAQETRRQRDVGVRGHGSEAARRTSRLSRAGPTPNEGAELTALTQK QHSTSHATSNIGSEKPSTRKEDYTAGLHIDPPRPVNHSYETTGVSRAYDAIRGV AYSGPLSQTHVSGSTSGRRPRRDHVKGLSGQSSLQPSRPFIVSDSRSERIYEKS HVTDLSNHSRLAVGRNRDTTDPHRSLSTLMQQIQDGTLDGIDIGTHEYARAPVS STKQKSAQLQRPSALKYVDNVQLQNTRVGSRQSDERPANKESDMVSHRQGQRIH CSGPLLHPSANIEDLLQRHEQQIQQAVRRAHHGKREALSNRSSLPGKKPVDHRA WVSSGRGNKESPYFRGKGNKELSDLRGGPTAKVTNFRQKVM | 187 | 2580 |
| 393 | CDK type C | MAVANPGQLNLQEAPSWGSRSVNCFEKLEQIGEGTYGQVYMAKEIETGEIVALK RIRMDNEREGFPITAIREIKLLKKLQHENVIKLKEIVTSPGPEKDEQGKSDGNK YNGSIYMVFEYMDHDLTGLAERPGMRFSVPQIRCYMKQLLIGLHYCHINQVLHR DIRGSNLLIDNNGILKLADFGLARSFCSDQNGNLTNRVITLWYRPPELLLGSTK YGPAVDMWSVGCIFAELLYGRPILPGKNEPEQLTKIFELCGSPDESMWPGVSKL PWYSNFKFQRQMKRRVRESFKNFDRHALDLVEKMLTLDPSQRISAKDALDAEYF WTDPVPCAPSSLPRYEPSHDFQTKRKRQQQRQHDEMTKRQKISQHPPQQHVRLP PIQNAGQGHLPLRPGPNPTMHNPPPQFPVGFSHYTGGPRGAGGQNRHPQWIRPL HAAQGGGYNANRGYGGPPQQQGGGYPPHGMGNQGPRGGQFGGRGAGYSQGGPYG GPVGGRGPNVGGNRGPQFWSEQ | 220 | 1749 |
| 394 | CDK type D | MQNMEDNVQSSWSLHGNKEICARYEILERVGSGTYSDVYRGRRKADGLIVALKE VHDYQSSWREIEALQRLCGCPNVVRLYEWFWRENEDAVLVLEFLPSDLYSVIKS GKNKGENGIPEAEVKAWMIQILQGLADCHANWVIHRDLKPSNLLISADGILKLA DFGQARILEEPEAIYEVEYELPQEDIVADAPGERLMEEDDSVKGVRNEGEEDSS TAVETNFGDMAETANLDLSWKNEGDMVMQGFTSGVGTRWYHAPELLYGATIYGK SIDLWSLGCILGELLILEPLFSGTSDIDQLSRLVKVLGTPTEENWPGCSNLPDY RKLCFPGDGSPVGLKNHVPSCSDSVFSILSRLVCYDPAARLNAKEVLENKYFVE DPYFVLTHELRVPSPLREENNFSEDWAKWKDMEADSDLENIDEFNVVHSSDGFC IKFS | 438 | 1748 |
| 395 | CDK type D | MDLNQYPEDLNPELPEGTDNVDNPDNNKGSPVPSPHPPLKPLDPSERYRKGITL GQGTYGIVYKAFDTVTNKTVAVKKIHLGKAKEGVNVTALREIKLLKELSHPNII QLIDAYPHKQNLHIVFEFMETDLEAVIKDRNLVFSPADIKSYLQMTLKGLAVCH KKWVLHRDMKPNNLLIAADGQLKLGDFGLARLFGSPDRKFTHQVFAVWYRAPEL LFGAKQYGPAVDIWATGCIFAELLLRKPFLQGVSDLDQIGKIFAAFGTPRQSQW PDVASLPDFVEFQFVPAPSLRSLFPMASEDALDLLSKNFTLDPKNRITAQQALE HRYFSSVPAPTRPDLLPKPSKVDSSRPPKHASPDGPVVLSPSKARRVMLFPNNL AGILPKQVSQSTTGGTPIEFDMPTQKLREVCPRSRITESGKKHLKRKTMDMSAA LDECAREQEGQEGKTILDPDHQRSAKKEKHM | 240 | 1631 |
| 396 | Cyclin A | MAGGQENCVRITRARAACVSKASAPVIQSQVDSKKSRKRAPKRAAVDDLAANAS GSQPKRRAVLGDVTNLHAAATDCLSTAEDQVDAPNPSIKGRARNKKKEARTSTK VVKDEIHPESNPLADHSSNLSECQKPPAAKLAEQRSLRGVPSKAKQGGSSNSQS CSKHTDIDRDHTDPQMCTTYVEDIYEYLRNAELKNRPSANFMSTAQNDITPNMR AILVDWLVEVSEEYKLVPDTLYLTVSYIDRYLSANPTSRHKLQLLGVSCMLIAS KYEEVCPPHVEEFCYITDNTYTRDEMLSMERKILIFLNFEMTKPTTKSFLRRFV RASQAGNKAPSLHMEFLANYLAELTLMECSFLQYLPSLIAASTVFLSRLTLDFL TNPWNPTLAHYTGYKASQLRDCVMAIYNVQMNRKGSTLVAIREKYQQHKFKCVA SLPPPPFIAERFFEDTPN | 252 | 1604 |
| 397 | Cyclin A | MTGTQASNVRITRARAAKSTLNNALPPLPPAQGKPRGKRAATESNISGFSVAAE PLKRRAVLSDVSNICKEAAAVDCLKKPKAVKVVSQNANAKGRGRGIPRNNKKIT QEAEIKKETSPAICNVDDASAGNAIGDDKQNNVNPLKEVQDNPKELNPIAEQI | 261 | 1817 |

TABLE 15-continued

Peptide Table.

| Protein SEQ ID | Target | Patent PEPTIDE Sequence | Patent ORF start | Patent ORF stop |
|---|---|---|---|---|
| | | SVHPHCKQSVEKPNEKEIVVSDNKAAIASLKQQSTLQSLRIPKQPKYSLKQGNP VPLANLHEDVGRSSCSDFIDIDSEYKDPQMCTAYVTDIYANMRVVELKRRPLPN FMETTQRDINANMRSVLIDWLVEVSEEYKLVPDTLYLTVSYIDRFLSANVVNRQ RLQLLGVSCMLVASKYEEICAPPVEEFCYITDNTYKKEEVLEMEISVLNRLQYD LTTPTTKTFLRRFIRAAQASCKVSSLHLEFMGNYLAELTLVEYDFLKYLPSLIA AAAVFVARMTLDPMVHPWNSTLQHYTGYKVSDMRDCICAIHDLQLNRKGCTLAA IREKYNQPRFKCVANLFPPPIISPQFLIDNEV | | |
| 398 | Cyclin B | MAAPNQNALLINNNNRRPLVDIGNLVGALNAQCNISKNGARKRAFGDIGNLVED LDAKCTISKYWVRKRPRTNFGVNANKGASSSTQGQGIVVRGEQKAWDRIVWGNK QSCAIKMNAQHVTATQRGTAISISDIIDSSVQDGGIKAPSQLRARKQTVRTVTA TLTARSEDSLRDVLEVPPGIDDGDRDNPLAVVEYVEDIYHFYRKIEVRSCVPPD YMTRQLEIKDSMRGVIIDWLIEVHRTFLLMPETLYLTVNIIDRYLSIQSVTRNE LQLNGITAMFIASKYEEISPPKINDLVYITKDAYTSKQIVNMEHTILNRLKFKL TVPTPYVFLVRFLKAAGPDKVMKNLAFFLVDLCLLHYKMIKYSPSMLAAAAVYT AQCTLKRHPYWNKTLILHIGYSEAHLRECAHLMADLHLKAEGSNLKSVYKKYSY PIFGSVAFLSPARIPAGTVAAPAIDKCAHQIYLRNLR | 167 | 1576 |
| 399 | Cyclin B | MFPNKQTQGLVQNKKMASKAAQPKANVPPQRVPPAANNRRALGDIGNIVADVGG KCNVTKDGVNGKPLAQVSRPITRSBGAQLLAQAAANKGISAANNQTQVPVVIPK ADVRGNKQRRTSRSKDIPPTTVVTNESDDCVIIEQAQRIKPTCNHNVGAVGNKE KPQLLTAKPKSLTASLTSRSAVALRGFRFDDDEMTEAEEDPLPNIDVGDRDNQLA VVEYVEDIYKFYRRTEQMSCVPDYMPRQQEINPKMRAVLINWLIEVHYRFGLMP ETLYLTTNLIDRYLATQLVSRSNYQLVGATAMLLASKYEEIWAPEMNDFLDILE NKFERKHVLVNEKANLNKLRFHLTVPTPYVFLVRFLKAAASDEEMENLVFFLME LSLMQYVMIKFPPSMLAAAAVYTAQITLKKTTVWNDVLKRHTGYSEIDLKECTR LMVAFHQSSEESKLNVVFKKYSMPEYDSVALIKPAKLPA | 183 | 1598 |
| 400 | Cyclin D | MAPSFDCVANAYIESCEDQEKLRQNAQILAQSGENDVDEPVSNLVQRETHYMLP EDYLQRLRNRTLDVNVRREAVGWILKVHSFYNFGAPTAYLAVNYLDRFLSRHRM PQGVKAWMIQLMAVACLSLAAKMEETQVPLPSDLQREDARFIFQARTIQRHELL ILSTLQWGMRSITPFSFIDYFAYRAVQGHGHGNDATPKAVMSRAIELILSTTEE IDFMEYRPSAIAAAALLCAAEEVVPLQAVHYKRALSSSITDVDKDKMFGCYNLI QETIIEGGCYWTPMSLQSTEKTPVGVLDAAACLSNTPTSSYSVKPYASVTAAKR RKLNEICSALLVSQAHPC | 98 | 1126 |
| 401 | Cyclin D | MAANFWTSSHCKELLDAEKVGIVHPLDKDQGLTQEDVKIIKINMSNCIRTLAQY VKLRQRVVATAITYCRRVYTRKSFTEYDPQLVAPTCLYLASKAEESTVQAKLVI FYMKKYSKHRYEIKDMLEMEMKLLEALDYYLVIYHPYRPLIQFLQDAGLNDLKV TAWALVNDTYRTDLILTYPPYMIALACIYFACIMEEKDAQAWFEELRVDMNEIK NISMEIVDYYDNYRVIPDEKNNSALNKLPHRF | 148 | 894 |
| 402 | Cyclin D | MAPALSSSYECLSHLLCAEDASNVVGCWDEDESKIFCEEEEGFGIQHFPDFPVP DDDEIRVLVRKESQYMPGKSYVQSYQNLGLDFTARQNAIGWILKVHGSYNEGPL TAYLSINYLDRELSRNPLPKAKVWMLQLLSVACLSLAAKMEETQVPLLLDLQAE EPDFLFEPRTIQRNELLVLSTLEWRMLSVTPFSFVDYFLQGGGGRKPPPRAMVA RANELIFNTHTVLDFLEHRPSAIAAAAVICAAEEVLPLEAAQYKETILSCSLVD KEWVFGSYNLIQEVLIEKFSTPKKAKSASSSIPQSPVGVLDAFCLSNNSNNTSL EASLSVNLYASVAAKRRKLNDYCNTWRMFQHSTC | 287 | 1363 |
| 403 | Cyclin D | MAPNCIDCAPSDLFCAEDAFGVVEWGDAETGSLYGDEDQLHYNLDICDQHDEHL WDDGELVAFAEKETLYVPNPVEKNSAEAKARQDAVDWILKVHAHYGFGPVTAVL SIWYLDRFLSANQLQQDKPWMTQLAAVACLSLAAKMDETEVPLLLDFQVEEAKY IFESRTIQRMELLVLSTLEWRMSPVTPLSYIDHASRNIGLENHHCWIFTMRCKE I LLNTLRDAKFLGLLPSVVAAIMLHVIKETELVNPCEYENRLLSAMKVNKDMC ERCIGLLIAPESSSLGSFSLGLRKSSTINIPVPGSPDGVLDATFSCSSSSCGS GQSTPGSYDSNNSSILCISPAVIKKRKLNYEFCSDLHCLED | 251 | 1348 |
| 404 | Cyclin dependent kinase regulatory subunit | MPQIQYSEKYTDDTYEYRHVVLPPETAKLLPKNRLLNENEWRAIGVQQSRGWVH YAIHRPEPHIMLFRRPLNYQQNQQQQAGAQSQPMGLKAQ | 229 | 510 |
| 405 | Cyclin dependent kinase regulatory subunit | MQQIEYSEKYYDDTYEYRHVELPPDVARLLPKNRLLTENEWRGIGVQQSRGWVH YAIHCSEPHIMLFRRPLNYEQNHQHPEPHIMLFRRPLNCQPNHQPQAHHPT | 92 | 409 |

… 233                                                                 234

TABLE 15-continued

Peptide Table.

| Protein SEQ ID | Target | Patent PEPTIDE Sequence | Patent ORF start | Patent ORF stop |
|---|---|---|---|---|
| 406 | Cyclin dependent kinase regulatory subunit | MQQIEYSEKYYDDTYEYRHVELPPDVARLLPKNRLLTENEWRGIGVQQSRGWVH YAIHCSEPHIMLFRRPLNYEQNHQHPEPHIMLFRRPLNCQPNHQPQAHHPT | 64 | 381 |
| 407 | Cyclin dependent kinase regulatory subunit | MPQIQYSEKYYDDTYEYRHVVLPPDVARLLPKNRLLNEMEWRGIGVQQSRGWVH YAIHRPEPHIMLERRHLNYQQNQQQQAQQQPAQAMGLQA | 68 | 349 |
| 408 | Histone acetyltransferase | MALVETEPVTLIHPEEPKKFKKRPTPGRGGVISHGLTEEEARVKAIASIVGAMV EGCRKGEDVDLNALKAAACRRYGLSRAPKLVEMIAALPDGERAAVLPKLKAKPV RTASGIAVVAVMSKPHRCPHIATTGNICVYCPGGPDSDFEYSTQSYTGYEPTSM RAIRARYNPYVQTRSRIDQLKRLGHTVDKVEFILMGGTFMSLPADYRDYFIRNL HDALSGHTSSNVEEAVCYSEHSATKCIGLTIETRPDYCLGPHLRQMLSYGCTRL EIGVQSTYEDVARDTMRGHTVAAVADCFCLARDAGFKVVAHMMPDLPNVGVERD MESFREFFSNPAFRADGLKIYPTLVIRGTGLYELWKTGRYRHYPPEQLVDIIAR VLALVPPWTRVYRVQRDIPMPLVTSGVEKGNLRELALARNDDLGLKCRDVRTRE AGIQDIHHKIRPEVVELVRRDYCANEGWSTFLSYEDTRQDILVGLLLRLRKCGHN TTCPELKGRCSIVRELHVYGTAVPVHGRDADKLQHQGYGTLLMEQAERIAWKEH RSIKIAVISGVGTRHYYRKLGYELEGPYMMKYLN | 125 | 1849 |
| 409 | Histone acetyltransferase | MLGFRDLYTSICSHLQRASGRLPIIAAATSLISTPEIAAVEKENKAPNSVDKMG MGSADESGRFSTSNGQFMNMNNGVVKEEWKGGVPVVPSAPTTVPVITNVKLETP SSFDHDMARKRKLGFLPLEVGTRVLCKWRDGKFHPVKIIERRKLPNGATNDYEY YVHYTEFNRRLDEWVKLEQLELDSVETDADEKVDDKAGSLKMTRHQKRKIDETH VEGHEELDAASLREHEEFTKVKNITKIELGRYEIETWYFSPFPSEYNNCEKLYF CEFCLNFMKRKEQLQRHMRKCDLKHPPGDEIYRSGTLSMFEVDGKKNKVYAQNL CYLAKLFLDHKTLYYDVDLFLFYILCECDERGCHMVGYFSKEKHSEESYNLACI LTLPPYQRKGYGKFLISFSYELSKKEGKVGTPERPLSDLGLLSYRGYWTRVLLD ILKKHKSNISIKELSDMTAIKADDVLSTLQGLDLIQYRKGQHAICADPKVLDRH LKAVGRGGLEVDVCKLIWTPYKEQ | 70 | 1602 |
| 410 | Histone acetyltransferase | MGSLDESTCSEEIRDEGKDSIRTKFKVESTVNNAQNGGNDNSKKKRAAGLPLEV GIRLLCKWRDSKLHPVKIIERRKLPNGFPQDYEYYVHYTEFNRRLDEWVKLEQF ELDSVETDADEKIEDKGGSLKMTRHQKRKIDEIHVEEGQGHEDFPDPASLREHE FTKVKNIAKVELGRYEIETWYFSPFPPEYSHCEKLFFCEFCLNFMKRKEQLQRH MRKCDLKHPPGDEIYRHGTLSMFEVDGKKNKIYGQNLCYLAKLFLDHKTLYYDV DLFLFYVLCECDDRGCHVVGYFSKEKHSDEAYNLACILTLPPYQRKGYGKFLIA FSYELSKKEGKVGTPERPLSDLGLLSYRGYWTRILLDILKKQRGNISIKELSQM TAIKVEDVISTLQVLDLIQYRKGQHVICADPKVLDRHLKAAGIAGLEVDVSKLI WTPYKEQCG | 140 | 1465 |
| 411 | Histone acetyltransferase | MASAPMVGCDQSRDKHRWVESKVYMRKGHGKGSKGNAGFNAQNSTAQVRRENDN MGNSIADNGKSEAASEGLSSLSRKQITVNQDHPPNETSSMPAVGGLQNIDTHVT FKLEGCSKQEIWELRKKLTNELEQVRGTFKKLEARELQLRGYSVSAGVNTSYSA SQFSGNDMRNNGGKEVTSEVASGGAITPKQAQRESNPPRQLSISLMEMNQAASD MGEKGKRTPKANQYYRHSEFVLGKDKFPPAESKKSKSTGNKKISQSKVFSKETM QVGKEFMPQKSVNEVFKQCSLLLTKLMKHKYGWVFNLPVDAQALGLHDYHTIIK RPMDLGTVKSKLEKNLYNSPASFAEDVKLTFSNAMTYNPKGHEVHTMAEQLLQL FEERWKTIYEEHLDGKHRFGSGQGLGASSSTKKLPFQDSKKNIKKSEPAGGPSP PKPKSTNHHASRTPSAKKPKAKDPHKRDMTYEEKQKLSTNLQNLPQERELELIVQ IIKKRNPSLCQHDEEIEVDIDSFDTETLWELDRFVTMYKKSLSKMKKKALLADQ AKRASEHGSARNKHPMIGRELPMNNKKGEQGEKVVEIDHMPPVNPPVVEVEKDG VYAKRSSSSSSSSSDSGSSSSDSDSGSSSGSESDAYAATSPPAGSNTSARG | 628 | 2565 |
| 416 | Histone deacetylase | MMETGGNSLPSGPDGVKRKVAYFYDPEVGNYYYGQGHPMKPHRIRNTHALLVQY GLHKEMQILKPYPARDRDLCRFHADDYVAFLRGITPETIQDQVKALKRFNVGDD CPVFDGLYQYCQTYAGGSVGGAVKLNHKLCDIAINWAGGLHHAKKCEASGFCYV NDIVLAILELLKYHKRVLYVDIDIHHGDGVEEAFYTTDRVMTVSFHKFGDYFPG TGDIRDIGCGKGKYYAVNVPLDDGIDDESFQSLFKPIIQQVMLVYNPEAIVLQC GADSLSGDRLGCFNLSVKGHAECVRYMRSFNVPLLMVGGGGYTVRNVARCWCYE TGVAVGVEIDDRMPQHEYYEYFGPDYTVHVAPSNMENKNTKQYLDKIRSKILEN INSLPCAPSAQFQVQPPDTDFPELEEEDYDERTRSHKWDGASCDSDSENGDLKH RNHDVEESAFPRHNLANISYNTKIKLEGVGTGGLDMAAGTDTKKNDESFEAMDY ESGEELRQDHFASTINASQPCDPALLTGVQNQLQSTDTVKPIEQSGNAPGIPPP SVATVSTGTRPSSISRTSSLNSMSSVKQGSILGPNPPQGLNASGLQFPVPTSNS PIRQGGSYSITVQAPDKQGLQNHMKGPQNMPGNS | 365 | 2251 |

TABLE 15-continued

Peptide Table.

| Protein SEQ ID | Target | Patent PEPTIDE Sequence | Patent ORF start | Patent ORF stop |
|---|---|---|---|---|
| 417 | Histone deacetylase | MPPKDRVAYFYDGDVGSVYFGPNHPMKPHRLCMTHHLVLSYELHKKMEIYRPHK AYPVELAQFHSADYVEFLHRITPDTQHLFTKELVKYNMGEDCPVFENLFEFCQI YAGGTIDAAHRLNNQICDIAINWSGGLHHAKKCEASGFCYINDLVLGILELLKH HARVLYVDIDVHHGDGVEEAFYFTDRVMTVSFHKYGDMFFPGTGDVREVGEREG KYYAINVPLKDGIDDASFTRLFKTIITKVVDIYQPGAIVLQCGADSLAGDRLGC FNLSIDGHAQCVRIVKKFNLPLLVTGGGGYTKENVARCWSVETGVLLDTELPNE IPDNDYIKYFAPDYSLKINTAGNMENLNSKTYLSAIKVQVMENLRAIQHAPSVQ MHEVPPDFYIPDIDEDELNPDERMDQHTQDRQIQRDDEYYDGDNDIDHDMEEAS | 156 | 1454 |
| 418 | Histone deacetylase | MDSSKSEEANILHVFWHEGMLNHDLGTGVFDTLEDPGFLEVLEKHPENADRVRN MLSILRKGPIAPYTEWHTGRAAYLSELYSFHRPDYVDMLAKTSTAGGKTLCHGT RLNPGSWEAALLAAGTTLEAMRYILDGHGKLSYALVRPPGHHAQPTQADGYCFL NNAGLAVELAVASGCKRVAVVDIDVHYGNGTAEGFYERDDVLTISLHMNHGSWG PSHPQTGFHDEVGRGKGLGFNLMVPLPNGTGDKGYEHAMHELVVPAISKFMPEM IVLVIGQDSSAFDPNGRECLTMEGYRKIGQIMRQQADQFSGGRLVVVQEGGYHI TYAAYCLHATLEGVLCLPHPLLSDPIAYYPFHDIYSERVTFIKNYWQGIISTTD KRN | 203 | 1348 |
| 419 | Histone deacetylase | MEESGNALVSGPDGSKRRVTYFYDADIGNYYYGQGHPMRPHRMRMAHNLIVHYG LHQRMEVCRPHLAQSKDIRAFHTDDYIHFLSSVAPDTQQEQLRQLKRFNVGEDC PVFDGLFNFCQSSAGGSIGAALKLNRKDADIAINWAGGLHHAKKCEASGFCYVN DIVLGILELLKVHQRVLYIDIDIHHGDGVEEAFYTTDRVMTVSFHKGFDYFPGT GHIKDVGYGKGKYYALNVPLNDGIDDESYKHLFRPIIQKVMEVYQPEAVVLQCG ADSLSGDRLGCFNLSVKGHADCVRFVRSFNIPLMLVGGGGYTIRNVARCWCYET AVAVGVEPQDKLPYNEYYEYFGPDYTLYVAPSNMENLNTEKDLEKMRNVLLEQL SKIQHTPSVPFQERPPDTEFNDEEEEDMEKRSKCRIWDGEYVGSEPEEDGKLPR FDADTYERSVLKHENKRLVPVSNVEPLKRIKQEEDGAAV | 229 | 1644 |
| 412 | Histone acetyltransferase | MEGHSGALGFGQQESRSSQSPNLSPSPSHSASASVTSSGQKRKRNEVEHAGVAS NSTGMFAVPPSHIYSHLHPMSMSMPMPMHNSHPSSLSESRDGALTSNDDDDNLT GGNQSQLDSMSAGNTDGREDFDDEDDDDDDEEDDDEVEGDEEDQDHDPDADDDS DDGHDSMRTFTAARLDNGAPNSRNLKPKADAAGVAIAPTVKTEPILDTVKEEKV SGNNNNNSVSANNAQVAPSGSAVLLSAVKEEANKPTSDHIQTSGAYCAREESL KREEDADRLKFVCFGNDGIDQHMIWLIGLKNIFARQLPNMPKEYIVRLVMDRSH KSVMIIKQNQVVGGITYRPYLSQKFGEIAFCAITADEQVKGYGTRLMNHLKQHA RDVDGLTHPFLTYADNNAVGYFIKQDFTKEIKLEKERWHGYIKDYDGGILMECKI DPKLPYTDLPANIRWQRQTIDERIRELSNCHIVYSGIDIQRKEAGIPREPIRVE DIPGLKEAGWTTDQWGHSRFRLLNSPSEGLPNRQVLHAFMRSLHKAMVEHADAW PFKEPVDPRDVPDYYDIIKDPMDVKRMFTNARTYNTHETIYYKCANR | 55 | 1818 |
| 413 | Histone deacetylase | MEESGNSLTSGPDGSKRRVSYEYDSDIGNYYYSQGHPMKPHRIRMAHSLIVHYA LDEKMEVCRPNLLQSRELRVFHADDYISFLQSVTPETQHEQLRQLKRFNVGEDC PVFDGLYNFCQTYAGGSVGAAIKLNNKEADIAINWSGGLHHAKKCEASGFCYVN DIVLAILELLKVHQRVLYIDIDIHHGDGVEEAFYSTDRVMSVSFHKFGDYFPGT GHLKDVGYGKGKYYSLNVPLNDGIDDESYKNLFRPIIQKVMEIYQPEAVVLQCG ADSLSGDRLGCFNLSVKGHADCVRFLRSFNVPLVLVGGGGYTIRNVARCWCYET AVAVGVEPQDKLPYNEYYEYFGPDYTLHVAPSNMENQNSARELAKIRNTLLEQL KRIQHVPSVPFQERPPDTKFPEEDEEDYEKRPKGHKWGGEYFGSESDEEQEPQN RDIDISDKPGIRRQSPPNVEAAKKIKVEEEDGDIGIVNENDGAKWPLGEAG | 259 | 1710 |
| 414 | Histone deacetylase | MEESGNSLTSGPDGSKRRVSYFYDSDIGNYYYSQGHPMKPHRIRMAHSLIVHYA LDEKNEVCRPNLLQSRELRVFHADDYISFLQSVTPETQHEQLRQLKRFNVGEDC PVFDGLYNFCQTYAGGSVGAAIRLNHKEADIAINWSGGLHHAKKCEASGFCYVN DIVLAILELLKVHQRVLYIDIDIHHGDGVEEAFYSTDRVNSVSFHKFGDYFPGT GHLKDVGYGKGKYYSLNVPLNDGIDDESYKNLFRPIIQKVMEIYQPEAVVLQCG ADSLSGDRLGCFNLSVRGHADCVRFLRSFNVPLVLVGGGGYTIRNVARCWCYET AVAVGVEPQDKLPYNEYYEYFGPDYTLHVAPSNMENQNSAKELAKIRNTLLEQL KRIQHVPSVPFQERPPDTKFPEEDEEDYEKRPKGHKWGGEYFGSESDEEQKPQN RQIDISDKPGIRRQSPPUVEAAKKIKVEEEDGDIGIVNENDGAKWPLGEAG | 356 | 1807 |
| 415 | Histone deacetylase | MEFWGVEVKPGEALTCDPGDERYHMSQAAIGDKEGAKENERVSLYVHVDGKKF VLGTLSRGKCDQIGLDLVFEKEFKLSHTSQTGSVFVSGYTTVDHEALDGFPDDE DLESSEDEEEELAQITTLTAKENGGKTGAKPVKPESKSSVTDKAAAKGKPEVKP PVKKQEDDSDSDEDEDEDEDEDDDEDDEDMKDASASDDGDEEDDSDEESDD DEEEDEETPKPAAGKKRPMPASDNKSPATDKKAKITTPAGGQKPGADKGKKTEH IATPYPKHGAKGPASGVKGKETPLGSKQTPGSKVKNSSTPESGKKSGQFKCQSC SRDFATEGALSSHNAAKHGGK | 261 | 1298 |
| 420 | Histone deacetylase | MPPKDRVAYFYDGDVGSVYFGPNHPMKPHRLCMTHHLVLSYELHKKMEIYRPHK AYPVELAQFHSADYVEFLERITPDTQHLFTKELVKYNMGEDCPVFENLFEFCQI YAGGTIDAAHRLNNQICDIAINWSGGLHHAKKCEASGFCYINQLVLGILELLKH HARVLYVDIDVHHGDGVEEAFYFTDRVMTVSFHKYGDMFFPGTGDVKEVGEREG | 156 | 1454 |

TABLE 15-continued

Peptide Table.

| Protein SEQ ID | Target | Patent PEPTIDE Sequence | Patent ORF start | Patent ORF stop |
|---|---|---|---|---|
| | | KYYAIHVPLKDGIDDASFTRLFKTIITKVVDIYQPGAIVLQCGADSLAGDRLGC FNLSIDGHAQCVRIVRKFNLPLLVTGGGGYTKENVARCWSVETGVLLDTELPNE IPDNDYIKYFAPDYSLKINTAGNMENLNSKTYLSAIKVQVMENLRAIQHAPSVQ MHEVPPDFYIPDIDEDELNPDERMDQHTQDRQIQRDDEYYDGNDIDHDMEEAS | | |
| 421 | Histone deacetylase | MDLNLVSHGEEEEGVRRRKVGIVYDERMCKHATPEDQPHPEQPDRIRVIWDKLN SAGVLHKCVMVEAKEASEEQLAGVHSRKHIEVMKSIGTARYNKKKRDKLAASYE SIYFSQGSSEAALLAAGSVVEISEKVASGELDAGVAIVRPPGHHAEADKAMGFC LFNNIAIAAKHLVHERPELGVQEVLIVDWDVHHGNGTQHMFWTDPHVLYFSVHR FDAGTFYPGGDDGFYDKIGEGKGAGYNINVFWEQGKCGDADYLAVWDHVLVPVA KSYDPDMVLISGGFDAALGDPLGGCRLTPYGYSLMTKKLMEFAGGKIVLALEGG YNLRSLADSFLACVEALLKDGPSRSSVLTHPFGSTWRVIQAVRKELSSFWPALN EELQLPRLLKDASESFDKLSSSSSDESSASEDEKKIAEVTSIMEVSPDPSSILA LTAEDIAQPLAGLKIEEAGTDSQRSSDHTLLDLTNDDTQKLKQFEGEIFVMIGD EESVPSASSSKDQNESTVVLSKSNIKAHSWRLTFSSIYVWYASYGSNMWHPRFL CYIEGGQVEGMARRCCGSEDKTPPQRIQWKVVPHRMFFGRSYTNTWGSGGVSFL DFNCSDTSEAHVCLYKITLAQFNDLLLQENNLNCGTEHPLVDLSSIDAIRNGNS ILELIKDSWYGTLIYLGMEGGLPIVTFTCSVCDVEKFKHGQLPLCPPSSRYENI LIRGLVQGKKLSEDDATAYIRAASTSFLL | 27 | 2222 |
| 422 | Histone deacetylase | MADEDLDLSDVGEVEDEPGEEIESTPPLAVGQEKEINSLALKKKLLKVGTRWET PENGDEVTVHYTGTLPDGTKFDSSRDRGEPFTFKLGQGQVIKGWDQGIVTMKKG ERALFTIPPELAYGSSGVRPTIPPNATLQFDVELLSWTNIVDVCNDGGILKRII SEGEKYERPKDPDEVTVKYEAKLEDGTLVAKSPEEGVEFYVNDGHFCPAIAKAV ETMERGEEVILTIKPTYAFGERGKDAEEGFAAIPPNATLTTSLELVSFKAVIAV TEDKKVIKKILKEADGYDKPSDGTVVQIRYTAELQDGTIFEKKGYEGEEFFQFV VDEEQVIAGLDKAVETMKTGEIALITIGAEYGFGNFETQRDLAVIPPNSTLIYE VEMISFTKEKESWDMDTTEKIEASKQKKEQGNSLFKVGKYQRAAKKYEKAAEYI EHDSSFSAEEKKQSKVLKVSCNLNHAACRLKLKDFKEAVKLCSKVLELESQNVK ALYRRAQAYIETADLDLAEFDIKKALEIEPQNREVQLEYKILKQKQIEYNKKDA KLYGNMFARLNKLEAFEGKVLS | 71 | 1759 |
| 423 | Peptidylprolyl isomerase | MADEGLELSDVAEVEDEPGEEFESAPPLVVGQEKELNSSGLKKKLLKAGTRCET PENGDEVTVHYTGTLLDGTKFDSSRDRGEPFTFNIGQGQVIKGWDQGIVTMKKR EHALFTIPPELAYGASGMPPTIPPNATLQFDVELLSWTNIVDVCKDGGILKRII SDGEKYERPKDPDEVTVKYEAKLEDGMLVAKSPEEGVEFYVNDGNFCPAIVKAV KTMKKGENVTLTIKPAYAFGEQGKDAEEGFAAIPPNATITINLQLVSFKAVKEV TEDKKVIKKILKEADGYDKPSDGTVVQIRYTAKLQDGTIFEKKGYAGEEPFQFV VDEEQVIAGLDKAVETMKTGEVALITIGPEYGFGNIETQRDLAVIPPYSTLIYE VEMVSFTKEKESWDMNTTENIEASKQRKEQGNSLFKVGKYLRAAKKYDKAAKYI EHDNSFSAEEKKQSKVLKVSCNLNHAACCLRLKDFEKAVKLCSKVLELESQNYR ALYRRAQAYIETADLDLAEFDIKKALEIEPQNREVRLEYLILKQKQIEYNKKDA KLYGNMFARQNKLEAIEGKD | 358 | 2040 |
| 424 | Peptidylprolyl isomerase | MPNPKVFFDMQVGGAPAGRIVMELYADVVPKTAENFRALCTGEKGTGRSGKPLH FKGSSFHRVIPGFMCQGGDFTRGNGTGGESIYGEKFADENFVKKHTGPGILSMA NAGPNTNGSQFFICTAQTSWLDGKHVVFGQVVEGLEVVRDIEKVGSGSGRTSKP VVIADSGQLA | 238 | 756 |
| 425 | Peptidylprolyl isomerase | MPNPKVFFDMQVGGAPAGRIVMELYADVVPKTAENFRALCTGEKGNGRSGKPLH FKGSSFHRVIPGFMCQGGDFTRGNGTGGESIYGEKFADENFVKKHTGPGILSMA NAGPNTNGSQFFICTAQTSWLDGKHVVFGQVVEGLEVVRDIEKVGSGSGRTSKP VVIADSGQLA | 285 | 803 |
| 426 | Peptidylprolyl isomerase | MPNPKVFFDMQVGGAPAGRIVMELYADVVPKTAENFRALCTGEKGTGRSGKPLH FKGSSFHRVIPGFMCQGGDFTRGNGTGGESIYGEKFADENFVKKHTGPGILSMA NAGPNTNGSQFFICTAQTSWLDGKHVVFGQVVEGLEVVRDIEKVGSGSGRTSKP VVIADSGQLA | 190 | 708 |
| 427 | Peptidylprolyl isomerase | MPNPKVFFDMQVGGAPAGRIVMELYADVVPKTAENFRALCTGEKGTGRSGKPLH FKGSSFHRVIPGFMCQGGDFTRGNGTGGESIYGEKFADENFVKKHTGPGILSMA NAGPNTNGSQFFICTAQTSWLDGKHVVFGQVVEGLEVVRDIEKVGSGSGRTSKP VVIADSGQLA | 156 | 674 |
| 428 | Peptidylprolyl isomerase | MADDFELPESAGMNENEDFGDTVFKVGEEKEIGKQGLKKLLVKEGGSWETPETG DEVEVHYTGTLLDGTKFDSSRDRGTPFKFKLGQGQVIKGWDQGIATMKKGENAV FTIPPDLAYGESGSQPTIPPNATLKFDVELLSWASVKDICKDGGIFEEIIKEGE KWEHPKEADEVLVKYEARLEDGTVVSKSEEGVEFYVEDGYFCPAFAIAVKTMKK GEKVLLTVEPQYGFGHQGREAIGNDVARSTNATLVLDLELVSWKVVDEVTDDKK VLKKILKQGEGYERPNDGAVVKVEYTGKLEDGTIFEEKGSDEEPFEFMAGEEQV VDGLDRAVMTMEKGEVALVSVAAEYGYQTEIKTDLAVVPPKSTLIYEVELVSFV EEKESWDMNTAEEIEAAGKKKEEGNALFKVGKYFRASKKYEEATKYIEYDTSFS EEEKKQSKPLKVTCNLNNAACKLKLKDYTQAEKLCTKVLEVESQNVKALYRRAQ | 176 | 1912 |

TABLE 15-continued

Peptide Table.

| Protein SEQ ID | Target | Patent PEPTIDE Sequence | Patent ORF start | Patent ORF stop |
|---|---|---|---|---|
| | | AYIQTADLELAELDIRKALEIDPNNRDVKLEYRALKEKQKEYNKREAKFYGNMF ARMSKLEELESRKSGSQRVETANKEEGSDAMAVDGESA | | |
| 429 | Peptidylprolyl isomerase | MAASLTPLGAGLAYATIYDQAKVRKLEPTKRSLIALCQHSDSQHRRFITRKYHV NVQILNRRDAIRLIGLAAGLCIDLSLMYDARGAGLPPQENAKLCDTTCEKELEN APMIITESGLQYKDIEIGNGPSPPIGFQVAANYVAMVPSGQVFDSSLDKGQPYI FRVGSGQVIKGLDEGLLSMKVGGKRRLYIPGPLAFPKGLNSAPGRPRVAPSSPV IFDVSLEFIPGLESEEE | 64 | 765 |
| 430 | Peptidylprolyl isomerase | MSAASLSADMAIRGTILGKTALHVLGPQVVSQCRQPVMFKCPPHTLRKMRFSAQ DLQSKNFYSGFTPPFKSVFISTSKRSWQAGSARANSQDAAFQSKVTTKCFLDIEI GGDPAGRIVLGLFGEDVPKTAENFRALCTGEKGFGYKGSSFHRIIKDFMLQGGD FDRGDGTGGKSIYGRTFEDENFKLAHVGPGVLSMANAGPNTNGSQFFICTVRTP WLDKRHVVFGQVIEGMEIVKKLESEETNRTDRPKRPCRIVDCGELP | 93 | 881 |
| 431 | Peptidylprolyl isomerase | MGRIKPQTLLQQSKKKKVPGRISVSTIIVCNLIIIFLMFSLVGIYRQAKRNRA TSRSDGDEEMENFGRSKINSVPHQAIVNTTKGLITLELFGKSSAHTVEKFVEWS ERGYFNGLPFYRVIKHFVIQVGDPKFAGNREDWTVGGQLNVQLEFSPKHEAFML GTSKLEDQGDGFELFITTAPIPDLNDKLNVFGRVIKGQDVVQEIEEVDTDEHFQ PKSPIIINDVRLKDEL | 372 | 1070 |
| 432 | Peptidylprolyl isomerase | MARQSTLLLLFWSLVFLGAIVFTQAKHEELEEVTHKVYFDVDIAGKPAGRVVIGL FGKAVPKTVENFRALCTGEKGVGKSGKPLHYKGSFFHRIIPSFMIQGGDFTLGD GRGGESIYGTKFADENFKLKHTGPVFITTVTTDWLDGRHVVFGKIISGMDVVYK VEAEGRQSGQPKRKVRIADSGELSMD | 28 | 594 |
| 433 | Peptidylprolyl isomerase | MARQSTLLLLFWSLVFLGAIVFTQAKHEELEEVTHKVYFDVDIAGKPAGRVVIGL FGKAVPKTVENFRALCTGEKGVGKSGKPLHYKGSFFHRIIPSFMIQGGDFTLGD GRGGESIYGTKFADENFKLKHTGPGFLSMANAGPDTNGSQFFITTVTTDWLDGR HVVFGKIISGMDVVYKVEAEGRQSGQPKRKVKIADSGELSMD | 34 | 648 |
| 434 | Peptidylprolyl isomerase | MEMDEIQEQSQPQSSEKQDISQESDTGNDKTINAEKITSENAEVEEDDMLPPKV NTEVEVLHDKVTKQIIKEGSGNKPSRNSTCFLHYFAWAESTMHKFQDTWQEQQP LELVLGRERKELSGFAIGVAGMKAGERALLHVDWQLGYGEEGNFSFPNVPPRAN EMALAYMGDDFMFQLFGKYKDMANAVKNPCHLNMAQCLLKLNRYEEAIGQCNMV LAEDEKNIKALFRRGKARATLGQTDDAREDFQKVRKFSPEDKAVIRELRLLAEH DKQVYQKQKEMFKGLFGQKPEQKPKKLHWFVVFWQWLLSMIRTIFRNRSKTD | 481 | 1611 |
| 435 | Peptidylprolyl isomerase | MAGAGEGTPEVTLETSMGPITVELYHKHAPKTCRNFLELSRRGYYNNVKFHRVI KDFMVQGGDPTGTGRGGESIYGPRFEDEITRDLKHTGAGILSMANAGPNTNGSQ FFISLAPTPWLDEKHTIFGRVCKGMDVVKRLGNVQTDKNDRPIHDVKILRTTVK D | 93 | 584 |
| 436 | Peptidylprolyl isomerase | MMDPELMRLAQEQMSKISPDELMIQ4QRQIMANPDLMRMASENMKNLKPEDIRFA AEQMKNVRKEEMAEISERISRASPEEIEAMKARANLQSAYQLQVAQNLKDQGNQ LHARMRYSEAAEKYLQARNNLTGIPFSEAKSLLLASSSNLMSCYLKTGQYEECV QTGSEVLAYDAMNVKALYRRGQAYKQIGKLELAVADLRKAVEVSPEDETIAQAL REASTELMEKGGTQDQNGPRIEEIIEEEAVQPTAEKYPQSAPWJTSVTEDVSDD EQGSEDQNGFSRDSFQATNAPDGQMYAESLRNLTENPDMLRTMQSLMKNVDPDS LVALSGGKLSPDMVKTVSGMFGRNSPEEIQNMMKMSSTLSRQNPSTSSRFDDIT RGHSNMDSSPQSVSVDNDLFEENQNRVGESSTNLSSSAAFSGMPNFSAEMQEQV RNQMNDPATRQMFTSMIQNMSPEMMASMSEQFGVKLSPEDAVKAQNAMASLSPN DLDRLMNWATRLQTAIDYARKIRNWILGRPGLIFAISMLLLAIILHRFGYIGD | 250 | 1869 |
| 437 | Peptidylprolyl isomerase | MGVEREILRPGNGPRPRPGQSVTVHCTGYGRNEDLSQKFWSTKDPGQKPFTFTI CQGRVIRGWDEGVLDNQLGEIFKLRCSPDYGYGSNGFPAWGIRPNSVLVFEIEV LSVN | 84 | 422 |
| 438 | Peptidylprolyl isomerase | MPNPRCYLDITIGEELEGRILVELYSDVVPRTAENFRALCTGEKGIGPHTGVPL HYKGLPFHRVIKGFMIQGGDISAQNGTGGESIYGLKFDDENFQLKHERRGMLSM ANSGPNTNGSQFFITTTRTSHLDGRHVVFGKVIKGMGVVRGIEHTPTESNDRPS LDVVISDCGEIPEGSDDGIANFFKDGDLYPDWPADLDEKSAEISWWMNAVDSAK CFGNENYKKGDYKMALRKYRRALRYLDICWEKEEIDEERSNHLRKTKSQIFTNS SACKLKLGDLKGALLDTEFAMRDGEDNVKALFRQGQAYMALKDVDSAVASFRKA LQLEPNDAGIRKELAVATKMINDRRDQERRAYARMFQ | 128 | 1213 |
| 439 | Peptidylprolyl isomerase | MGDVIDLNGDGGVLRTIIRSAKPGANQPTEDLPNVDVHYEGTLADTGEVFDTTR EDNTLFSFELGKGTVIKAWDIAVKTMKVGEVARITCKPEYAYGSAGSPPDIPEN ATLIFEVELVACKPRKGSTFGSVSDEKARLEELRKQREIAAASKEEEKKRREEA KATAAARVQAKLEARRGQGRGKGKSKGK | 265 | 837 |

TABLE 15-continued

Peptide Table.

| Protein SEQ ID | Target | Patent PEPTIDE Sequence | Patent ORF start | Patent ORF stop |
|---|---|---|---|---|
| 440 | Peptidylprolyl isomerase | MGLGLRIASASFLPIFNIMATRSLCILLVCFIPVLAHVLSLQDPELGTVRVYFQ TTYGDIEFGFFPHVAPRTVEHIYKLVRLGCYNSNHFFRVDRGFVAQVADVVGGR EVPLNSEQRKEGEKTIVGEFSEVKHVRGILSMGRYSDPDSASSSFSILLGNAPH LDGQYAVFGKVTKGDDTLKRLEEVPTRQEGIFVMPLERIRILSTYYYDTNERES NLTCDHEVSILKRRLVESAYEIEYQRRKCLP | 38 | 781 |
| 441 | Peptidylprolyl isomerase | MASRRSLRTMNVWPTLPPLVLLLLCFSSMSSSVVAKKSDVSELQIGVKHKPKS CDIQAHRGDRIRVHYRGSLTDGTVFDSSFERGDPIEFELGSGQVIKGWDQGLLG MCVGERRKLRIPSRLGYGAQGSPPKIPGGATLIFDTELVAVNGKGISNDGDSDL | 38 | 526 |
| 442 | Peptidylprolyl isomerase | MSGAPAERPISYFDITIGGKPIGRIVFSLYADLVPRTAENFRALCTGERGIGRS GRPLCYAGSGFHRVIRGFMCQGGDFTAGNGTGGESIYGEKFEDEAFPVRHTKPF LLSMANAGKDTNGSQFFITVSQTPHLDDRHVVFGEVIRGRSIVRAIENYPTASG DVPTSPIIISACGVLSPDDPSLAASEETIGDSYEDYPEDDDSDVQNPEVALDIA RKIRELGNRLFKEGQIELALKEYLESIRYLDVHPVLPDDSPPELKDSYDALLAP LLLNSALAALRTQPADAQTAVKNATRALERLELSDADKAKALYRRASAHVILKQ EDEAEEDLVAASQLSPEDMAISSKLKEVKDEKKKKREEEKRAFKKMFSS | 37 | 1158 |
| 443 | Peptidylprolyl isomerase | MASSLRSSLFSSWALDSRSVCSLFNLNPGKMGLPSISTPLNWRTCCCSHSSELL ELNEGLQSSRRRTVMGLSTVIALSLVYCDEVGAVSTSKRALRSQRVPEDEYTTL PNGLRYYDLKVGSGTEAVKGSRVAVHYVARWRGITFMTSRQGMGITGGTPYGFD VGASERGAVLKGLDLGVQGMRVGGQRILIVPPELAYGNTGIQEIPPNATLEFDV ELISIRQSPFGSSVKIVEG | 61 | 768 |
| 444 | WD40 repeat protein | MGAIEDEEPPLKRLKVSSPGLRRGLEEEAPSLVGSVSILMAKSLSLEEGETVG SEGLIRRVEFVRIITQALYSLGYQKAGALLEEESGILLQSSNVALFRKQILDGK WDESVVTLRGIDQVEVEGNTLKAASFLILQQKFFELLDKGNIPEAMKTLRLEIS PMQLNTKRVHELASCIVFPSRCEELGYSKQGNPKSSQRMKVLQEIQQLLPPSIM IPEKRLERLVEQALNVQREACIFHNSLDPALSLYTDHQCGRDQIPTTTLQVLES HKNEVWFLQFSNNGKYLASASKDCSAIIWEITEGDSFSMKHRLSAHQKPVSFVA WSPDDKLLLTCGIEEVVKLWNVETGECKLTYDKANSGFTSCGWFPDGERFISGG VDKCIYIWDLEGKELDSWKGQGMPKISDLAVTSDGKEIISICGDNAIVMYNLDT ETERLIEEESGITSLCVSKDSRFLLLNLANQEIHLWDIGARSKLLLKYKGHRQG RYVIRSCFGGSDLAFVVSGSEDSQVYIWHRGNGELLAVLPGHSGTVNCVSWNPV NPHVFASASDDYTIRIWGVNRNTFRSKNASSSNGVVHLANGGP | 421 | 2172 |
| 445 | WD40 repeat protein | MPGTTAGAGIEPIEFQSLKKLSLKSLKRSFDLFASLHGEPQPPDQRSQRIRIAC KVRAEYEVVKNLPTLPQREVGSSVSNSNVGETHSSLTTNQAQGFPTDTSGDLSK DEGREITSIAVHLQPQTGLIDGKAGAIAGTSTAISSVGSSDRYQPSAAIMKRLP SKWPRPIWHPPWKNYRVISGHLGWVRSVAFDPGNEWFCTGSADRTIKIWEVATG KLKLTLTGHIEQIRGLAVSSRHPYLFSAGDDKQVKCWDLEYNKAIRSYHGHLSG VYCLALHPTLDILCTGGRDSVCRVWDIRTKAQIFALSGHENTVCSVFTQAIDPQ VVTGSHDTTIKLWDLAAGKTMSTLTYHKKSVRAIAKHPFEHTFASASADNIKKF KLPKGEFLHNMLSQQKTIVNAMAINEDNVLVSAGDNGSLWFWDWKSGHNFQQAQ TIVQPGSLDSEAGIYALQYDITGSRLVSCEADKTIKMWKEDETATPESHPINFK APKDIRRF | 163 | 1647 |
| 446 | WD40 repeat protein | MRPILMKGNERPLTFLKYNRDGDLLFSCAKDHTPTVWYGHNGERLGTYRGHNGA VWCCDVSRDSTRLITSSADQTAKLWNVETGAQLFSFNFESPARAVDLAIGDKLV VITTDPFMELPSAIHIKRIEKDLSKQTADSVLTITGIKGRINAVWGPLNSTII SGGEDSVVRIWDSETGKLLRESDKETGHQKPITSLCKSADGSHFLTGSLDKSAR LWDIRTLTLIKTYVTERPVNAVAISPLLDHVVIGGGQEASHVTTTDRRAGKFEA KFFHKILEEEIGGVKGHFGPINSLAFNPDGRSFASGGEDGYVRLHHFDPDYFHI KM | 192 | 1172 |
| 447 | WD40 repeat protein | MRPILMKGHERPLTFLKYNRDGDLLFSCAKDHTPTVWYGHNGERLGTYRGHNGA VWCCDVSRDSTRLITSSADQTAKLWNVETGNQLFSFNFESPARAVDLAIGDKLV VITTDPFMELPSAIHIKRIEKDLSKQTADSVLTITGIKGRINAVWGPLNSTII SGGEDSVVRIWDSETGKLLRESDKETGHQKAITSLCKSADGSHFLTGSLDKSAR LWDIRTLTLIKTYVTERPVNAVAISPLLDHVVIGGGQEASHVTTTDRRAGKFEA KFFHKILEEEIGGVKGMFGPINSLAFNPDGRSFASGGEDGYVRLHHFDPDYFHI KM | 131 | 1111 |
| 448 | WD40 repeat protein | MAENNVGDFIPLDRQEYPSKPAPGAVDSSFWKSFKKKEVSRQIAGVTCINFCPE PPHDFAVTSSTRVHIYDGKSCELKKTITKFKDVAYSGVFRSDGQIIAAGGETGV IQVFNAKSQMVLRQLKGHGRPVRVVRYSPQDKLHLLSGGDDSMVKWWDITTQEE LLNLEGHKDYVRCGAASPSSVNLWATGSYDHTVRLWDLRNSKTVLQLKHGKPLE DVLFFPSGGLLATAGGNVVKVWDILGGGRPIHTMETHQKTVMAMCISKVPRSGQ ALGDAPSRLVTASLDGYNKVFDLDHFKVTHSARYPAPILSMGISSLCRTMAVGT SSGLLFIRQRKGQIEDKIHSDSSGLQVNPVNDEKDSAVLKPNQYRYYLRGRSEK PSEGDYVVKRMAKVYFQEYDKDLRHFNHSKALVSALKAADSKGTVAVIEELVAR KRLIQTLSILNLDELELLINFLSRFILVPKYSRFLISLTDRVLDARAVDLGKSE NLKKQIADLKGIVVQELRVQQSMQELQGIIEPLIRASAR | 149 | 1726 |

TABLE 15-continued

Peptide Table.

| Protein SEQ ID | Target | Patent PEPTIDE Sequence | Patent ORF start | Patent ORF stop |
|---|---|---|---|---|
| 449 | WD40 repeat protein | MDVETSPTGNKRTYTRLPRQVCVFWQEGRCTRESCNFLHVDEPGSVKRGGAT NGFAPKRSYNGSDERDTLAAGPPGGSRRNISARWGRGRGGIFISDERQKIRNKV CNYWLAGNCQRGEECKYLHSFVMGSDVKFLTQLSGHVKAIRGIAFPSDSGKLYS GGQDKKVIVWDCQTGQGTDIPLNDEVGCLMSEGPWIFVGLPNAVKAWNILTSTE LSLVGPRGQVHALAVGNGMLFAGTHDGSILAWKFSPASNTFEPAASLVGHTQAV VSLVSGADRLYSGSMDKTIRVWDLGTFQCLQTLRDHTSVVMSLLCWDQFLLSCS LDNTVKVWVATSSGALEVTYTHNEEHGVLALCGMNDEQAKPVLLCSCNDNTVRL YDLPSFSERGRIFSRNEVRTFQIAPGGLFFTGDATGELKVWNWATQKS | 948 | 2228 |
| 450 | WD40 repeat protein | MSVQELRERHAAATAKVNALRERIKAKRLQLLDTDVATYASSNGRTPISFSFTD LVCCRTLQGHTGKVYSLDWTSEKNRIVSASQDGRLIVWNALTSQKTHAIKLPCA WVMTCAFSPSGQAVACGGLDSVCSIFQLNNQLDRDGHLPVSRILSGHRSYVSSC QYVPDGDTHVITGSGDRTCIQWDVTTGQRIAIFGGEFPLGHTADVMSVSISAAN PKEFVSGSCDTTTRLWDTRIASRAIRTFHGHEADVNTVKFFPDGLRFGSGSDDG TCRLFDIRTGHQLQVYRQPPRENQSPTVTAIAFSFSGRLLFAGYSNGDCFVWDT ILEKVVLNLGELQNTHMGRISCLGLSADGSALCTGSWDKNLKIWAFGGHRKIV | 332 | 1465 |
| 451 | WD40 repeat protein | MKVKIISRSTDEFTRERSNDLQRVFRNFDPNLHTQARAQEYVRALNAAKLDKIF AKPPLAAMSGHIDGISAMAKSPRHLKSIFSGSVDGDIRLWDIAARRTVQQFPGH RGAVRGLTVSTEGGRLISCGDDCTVRLWDIPVAGIGESSYGSENVQKPLATYVG KNSFRAVDYQWDSNVFATGGAQVDIWDHDRSEPTNSFAWGSDTVISVRFNPAEK DIFATTASDRSIVLYDL8MASPLNKLIMQTRNNAIAWNPREPMNFTAANEDCNC YSYDMRRMNISTCVHQDHVSAVMDIDYSPSGREFVTGSYDRTVRIFPYNAGHSR EIYHTKRMQRVFCVKFSGDATYVVSGSDDANIRLWKAKASEQLGVLLPRERKRH EYLDAVKERFKHLPEIKRIERHRHLPKPIYKAALLRHTVNAAAKRKEERKRAHS APGSVVTNPLRKKRIVAQLE | 232 | 1590 |
| 452 | WD40 repeat protein | MDHYYQDDFDYLVDDEMVDFADDVEDDVRTRRRSDIDSDSEMDFDLNNKSPDTT ALQAKRGKDIQGIPWNRLNFTREKYRETRLQQYKNYENLPRPRRSRNLDKECTN FERGSSFYDFRHMTRSVKATIVHFQLRNLVWATSKHNVYLMQNYSIMHWSSLRQ KGEEVLMVAGPIVPSVKHPGSSPQGLTRVQVSAMSVKDNLVVAGGFQGELICKY LDKPGVSFCTKISHDENGITNAVEIYNDASGATRLMTANNDLAVRVFDTEKFTV LERFSFPWSVNHTSVSPDGKLVAVLGDNADCLLADCKTGKTVGTLRGHLDYSFA AAWHPDGYILATGNQDTTCRLWDVRKLSSSLAVLKGRMGAIRSIRFSSDGRFMA MAEPADFVHLYDTRQNYTKSQEIDLFGEIAGISFSPDTEAFFVGVADRTYGSLL EFNRRRMNYYLDSIL | 207 | 1550 |
| 453 | WD40 repeat protein | MAEALVLRGTMEGHTDAVTAIATPIDNSDMIVSSSRDKSILLWNLTKEPEKYGV PRRRLTGHSHFVQDVVISSDGQFALSGSWDSELRLWDLNTGLTTRRFVGHTKDV LSVAFSIDNRQIVSASRDRTIRLWNTLGECKYTIQPDAEGHSNWISCVRFSPSA TNPTIVSCSWDRTVKVWNLTNCKLRNTLVGHGGYVNTAAVSPDGSLCASGGKDG VTMLWDLAEGKRLYSLDAGDIIYALCFSPNRYWLCAATQQCVRIWDLESKSIVA DLRPDFIPNKRAQIPYCTSLSWSADGSTLFSGYTDGKIRVWGIGHV | 21 | 1171 |
| 454 | WD40 repeat protein | MAAIKSTSRSASVAFAPDAPLLAAGTMAGAIDLSFSSLANLEIFKLDFQSDDPE LPVVGECPSNERLNRLSWGSAGGSFGIIAGGLVDGTINIWNPATLINSEDNGDA LIARLEQHTGPVRGLEFNTISTNLLASGAEDGELCIWDLANPTAPTHFPPLKGV GSGAQGEISFLAWNRKVQHILASTSYSGTTVVWDLRRQKPIISFPDATRRRCSV LQWNPDASTQLIVASDDDNSPTLRAWDLRNTISPYKEFVGRSRGVIANSWCPSD SLFLLTCAKDNRTLCWDTGSSGEIVCELPAGANWNFDVQWSPKIPGILSTSSFDG KIGIHNIEACSRNVSGEVEFGGAIVRGGPSALLKAPKWLERFAGVSFGFGGRLA SFRFSTVAQAADHRHSEVFIHNLVTEDNLVIRSTEFEAAIADGEKVSLRALCDR KAEESQSDEEKETWNFLRVMFEDEGTARTKLLEHLGFKVQSEENGDLQETHSSK IDDIGSEIGKTLTLDDKTEEDVLPQLKGGQDAAIPQDNGEDFFDNLHSPKESVS LSHVGNDFVGEKDKDMVVNGAEIEHETEDLTEYSDWNEAIQHSLVVGDYKGAVL QCLSANRMADALIIAHLGGNSLWEKTRDEYLKKAKSSYLKVVSAMVNNDLTGLV NSRPLKSWKETLAMLCTYSQREEWTVLCDNLASRLIAAGNVMAATLCYICAGNI EKTVEIWSRSLKYDYDGRSFVDRLQDVMEKTVVLALATGQKRVSPSLSKLVENY AELLASQGLLTTAMEYLKLLGTEESSHELSILRDRLYLSGTDNKVEASSFPPET RQDLTESQYNMHQTGFGAPETQKNYQENVHQVLPSGSYTDNYQPTANTHYIAGY QPAPQQQPSFQNYFTPASYQPAPSPNVFYPSQVSQAEQSNFAPPVNQPPMKTFV PSTPPILRNVDQYQTPSLNPQLYQGVSSATVETHPYQTGAPASVSVGTTPGQPS VVPNFMVPGPVTAPTVTPRGFMPVTTPTQHPLGSANPPVQPQPSSPQVQSVTA ATTPPPTIQNVDTSNVAAEIRPVIGTLRRLYDETSEALGGARANPAKRREIEQN SRRIGSLFAKLNSGDISSNAASKLVHLCQALESRDYATAFQIQVGLTTSDWDEC SFWLAALKRMIKVKQNNR | 221 | 3679 |
| 455 | WD40 repeat protein | MAGAADSQLQTLSERDSTPNFKNLHTREYAAHKKKVHSVAWNCTGTKLASGSVD QTARVWNIEPHGHSKTKDLELKGHADSVDQLCWDPKHSELLATASGDRTVRLWD ARSGKCSQQVELSGENINITFKFDGTHIAVGNRDDELTIIDVRKFKPLHKRKFS YEVNEIAWNTTGELFFLTTGNGTVEVLSYFSLQVLHTLVAHTAGCYCIAIDPIG RYFAVGSADALVSLWDLSEMLCVRTFTELEWPVRTISFNHDGQYIASASEDLFI | 269 | 1252 |

TABLE 15-continued

Peptide Table.

| Protein SEQ ID | Target | Patent PEPTIDE Sequence | Patent ORF start | Patent ORF stop |
|---|---|---|---|---|
| | | DIADVQTGRTVHQISCRAAMNSVEWNPKYNLLAFAGDDKNKYMQDEGVFRVFGF ETP | | |
| 456 | WD40 repeat protein | MAATSPVGAGSGRELANPPTDGISNLRFSNHSDHLLVSSWDRKVRLYDASANSL KGQFVEGGPVLDCCFHDDASGFSGSADNTVRRYDFSTRKEDILGRHEAPVRCVE YSYAAGQVITGSWDKTLKCWDPRGASGQEKTLVGTYSQLERVYSMSLVGHRLVV ATAGRHINVYDLRNNSQPEQRRESSLKYQTRCVRCYPNGTGFALSSVEGRVAME FFDLSEAGQAKKYAFKCHRKSEAGRDTVYPVNAIAFHPIYGTFATGGCDGYVNV WDGNNKKRLYQYSKYPTSIAALSFSRDGRLLAVASSYTFEEGEKPHEPDAVFVR SVNEAEVKPKPKVYAAPP | 214 | 1242 |
| 457 | WD40 repeat protein | MASDDEEGFKNEEAPGVVDEAEVQEGLRACFPLSFGKQEKKQAPLESIHSATKR PEDPRPRRQLGPPRPPPSILAEQEDSDRFVGPPRPPQFVRDDNDDGEAEIMIGP PRPPAQYSDDHDNEETIGPPKPSYLEKGEETDQMVGPSKRGSDDETSGDSDDGD DAVDFRVPLSNEIVLRGHTKVVSALAIDQTGSRVLTGSYDYSVRMYDFQGMTSQ LKSFRQLEPAEGHQVRSLSWSPTSDRFLCVTGSAQAKIFDRDGLTLGEFVKGDM YLRDLKNTRGHISGLTCGEWHPKEKQTILTCSEDGSLRIWDVNDFNTQKQVIKP KLAKPGRVPVTACAWGRDGKCIAGGVGDGSIQVWNLKPGWGSRPDLYVAKGHDD DITGLQFSADGNILLTRSTDETLKVWDLRKAITPLQVFRDLPNNYAQTNVAFSP DERLIFTGTSVERDGMSGGLLCFYDRQTLELVLRIGVSPVHSVVRCTWHPRHNQ VFATVGDKREGGAHILYDPALSERGALVCVARAPRKKSLDDFEAKPVIHNPHAL PLFRDEPSRKRQREKARMDPMKSQRPDLPVTGPGFGGRVGSTKGSLLTQYLLKE GGLIKETWMEEDPREAILKYADVAARDPKFIAPAYAQTQPETVFAETDSEEEQK | 119 | 2065 |
| 458 | WD40 repeat protein | MKERGQSHAGQPSVDERYTQWKSLVPVLYDWLANHNLVWPSLSCRWGPQMHQAT YKNSQRLYLSEQTDGTVPNTLVIATCEVVKPRVAAAEHISQFNEEARSPFVKKF KTIIHPGEVNRIRELPQNSKIVATHTDGPDVLIWDVDTQPNRQATLGAADSRPD LVLTGHKDNAEFALAMSPSAPFVLSGGKDKCVLLWSIQDHISAATEPSSAKASK TPSSAHGEKVPKIPSIGPRGVYKGHKDTVEDVQFCPSNAQEFCSVGDDSALILW DARNGNEPVIKVEKAHNADLHCVDWNPHDENLILTGSADNSVRNFDRRNLTSSG VGSPVHKFEGHSAPVLCVQWCPDKASVFGSAAEDSYLNVWDYEKVGKNVGKKTP PGLFFQHAGHRDKVVDFHWNSFDPWTIVSVSDDGESTGGGGTLQIWRMSDLIYR PEDEVLAELERFRAHILSCQNK | 186 | 1550 |
| 459 | WD40 repeat protein | MSSLSRELVFLILQFLDEEKFKESVHKLEQESGFFFHMKYFDEKAQAGEWDEVE RYLSGFTKVDDNRYSMKIFFEIRKQKYLEALDRQDRAKAVDILVKDLKVFSTFN EELYKEITQLLTLDNFRENEQLSKYGDTKSARTIMMSELKKLIEANPLFREKLI YPNLKASRLRTLINQSLNWQHQLCKNPRPNPDIKTLFTDHACGPPMGARTPTQP TASLGVLPKATTFTPIGPHGPFFSSSTATSGLASWMSMPNMVTSPQAPVAVGPS VPVPPNQATLLKRPRTPPGSSSVVDYQTADSEQLIKRLRPVSQSIDEATYPGPT LRVPWSTDDLPKTLARALNEPYPVTSIDFHPSQQTFLLVGTKNGEITLWEVGSR EKLATRSFKIWDNANCSNHLEAAFVKDSSVSINRVLWSPDGTLIGIAFTKHLVH TYTFQGLDLRQHLEIDAHVGGVNDLAFSHPNKQLCVVTCGDDKMIKVWDAVTGR RLYNFEGHDAPVYSVCPHHKENIQFIFSTAVDGKIKAWLYDHLGSRVDYDAPGH SCTTMMYSADGTRLFSCGTSKEGESFLVEWNESEGAIKRTYSGLRKKGSGVVQF DTTQNHFLAVGDEHLIKFWDMDSTNMLTSCDAEGGLLNLPRLRFNKEGSLLAVT TVNGIKILANADGQKLLRTMENRTFDLPSRAHIDAASATSSPATGRMERIERTS SANTVSGINGVDPAQSSEKLRLSDDLSEKTKIWKLTEITDSIQCRCITLPENAA EPASKVSRLLYTNSGVGLLALGSNAVHKLWKWNRSEQNPSGKATASVHPQRWQP TSGLLMTNDITDINPEEAVPCIALSKNDSYVMSASGGKVSLFNMMTFKVMTTFM PPPPASTFLAFHPQDNNIIAIGMEDSTIHIYNVRVDEVKTKLKGHQKRITGLAF SSTQMILVSSGADAQLCVWNTETWEKRRSKTIQMPVGKTVSGDTRVQFHSDQLH ILVVHETQLAIYDAYKLERQYQWVPQDALSAPILYATYSCNRQLIYATFSDGHI GVYDAEILRPRCRIAPTTYLSSGTSSSTSLPLVVAAHPHEPNQFAIGLSDGAVQ VLEPSESEGKWGVSPPPENGWPAVVAGPSTSNQGSEQAPR | 244 | 3671 |
| 460 | WD40 repeat protein | MAKDEEEFRGEMEERLVNEEYKIWKKNTPFLYDLVITHALEWPSLTVQWLPDRE EPPGKDYSVQKMILGTHTSDNEPNYLMLAQVQLPLEDAENDARQYDQERGEIGG FGCANGKVQVIQQINHDGEVNRARYMPQNPFIIATKTVSAEVYVFDYSKHPSKP PQDGGCHPDLRLRGHNTEGYGLSWSPFKHGHLLSGSDDAQICLWDINVPAKNKV LEAQQIFKVHEGVVEDVAWHLREHYLFGSVGDDRHLLIWDLRTSATNKPLHSVV AHQGEVNCLAFNPPFNEWVLATGSADRTVKLFDLRKISSALHTFSCHKEEVFQIG WSPKNETILASCSADRRLMVWDLSRIDEFQTPEDALDGPPELLFIHGGHTSKIS DFSWNPCEDWVIASVAEDNILQIWQMAENIYHDEEDDMPPEEVV | 163 | 1431 |
| 461 | WD40 repeat protein | MSPGVKQTGSQKFESGHQDVVHDVTMDYYGKRIATCSA0RTIRLFGLNASDTPS LLASLTGHEGPVWQVAWAHPKFGSMLASCSYDGRVIIWREGQQENEWSQVQVFK EHEASVNSISWAPNELGLCLACGSSDGSITVFTCREDGSWDKTKIDQAHQVGVT AVSWAPASAPGSLVGQPSDPIQKLVSGGCDNTAKVWKFYNGSWKLDCFPPLQMH TDWVRDVAWAPNLGLPKSTIASCSQDGKVVIWTQGKEGDKWEGRILNDFKIPVW RVNWSLTGNILAVADGNNSVTLWREAVDGDWNQVTTVQ | 155 | 1081 |

TABLE 15-continued

Peptide Table.

| Protein SEQ ID | Target | Patent PEPTIDE Sequence | Patent ORF start | Patent ORF stop |
|---|---|---|---|---|
| 462 | WD40 repeat protein | MSSGVKQTGSQKFESGHQDVVHDVTMDYYGKRIATCSADRTIKLFGMNTSDTPT LLASLTGHEGPVWQVAWARPKFGSMLASCSYDRRVIIWREGQQENEWSQVQVFK EHEASVNSISWAPHELGLCLACGSSDGSITVFTGREDGSWDKTKIDQAHQVGVT AVSWAPASAPGSLVGQPSDPVQKLVSGGCDNTAKVWKFYNGSWKLDCFPPLQMH TDWVRDVAWAPNLGLPKSTIASCSQDGRVVIWTQGKEGDKWEGKILNDFKTPVW RISWSLTGNILAVADGNNNVTLWIFEAVDGEWNQVTTVQ | 537 | 1463 |
| 463 | WD40 repeat protein | MKKRSRPSNGHLSTAAKNKSRKTAPITKDPFFDSAHNRNKSKGKGKSRGKGEEI ESSDEDDDAIGRDAPAEEEEEIAEEEERETADEKRLRVAKAYLDKIRAITKANEE DNEEEAGEDEETEAERRGKRDSLVAEILQQEQLEESGRVQRQLASRVVTPSKLV ECRVVKRHKQSVTAVALTEDDLRGFSASKDGTIIHWDVETGASEKYEWPSQAVS VSSSFEVSKTQKGKGSKKQGSKHVLSMAVSSDGRYLATGGLDRYIHLWDTRTQK HIQAFRGHRGAVSCLAFRQGTQQLISGSFDRTIKLWSAEDRAYMDTLYGHQSEI LAVDCLRKERVLSVGRDHTLRLWKVPEETQLVFRGHAASLECCCFINNEDFLSG SDDGSIELWSMLRKKPVFMARNAHGHAIVENLSEDTSTREEPDEEVTTRQLPNG NSIGNGMTNQMGITPSVESWVGAVTVCRGTDLAASGAGNGVVRLWAIENSSKSL RALHDIPLTGFVNSLTFARSGRFLIAGVGQEPRLGRWGRIQAARNGVTLCPIEL S | 284 | 1909 |
| 464 | WD40 repeat protein | MAATFGTINTATSPHNPNKSFEIVQPPNDSISSLSFSPKANYLVATSWDNQVRC WEVLQTGASMPKAAMSHDQPVLCSTWKDDGTAVFSAGCDKQAKMWPLLTGGQPV TVAMHDAPIKDIAWIPEMNLLATGSWDKTLKYWDTRQSNPVHTQQLPERCFALS VRHPLMVVGTAQRNLIIFNLQNPQTEFRRISSPLKYQTRCVAAFPDKQGFLVGS IEGRVGVHHVEEAQQSKNFTFKCHRDSNDIYAVNSLNFHPVHQTFATAGSDGAF NFWDKDSKQRLKAMARSNQPIPCSTFNSQGSLYAYAVSYDWSKGAENHNPATAK HHILLHVPQESEIKGKPRVTTSGRK | 610 | 1659 |
| 465 | WD40 repeat protein | MVVMDKGTHQTNEDESESEFIDEDDVIDEISIDEEDLPDADVEGEDVQEDNKRS EPDENSSSLDDAINTFEGHEDTLFAVACSPVDATWVASGGGDDKAFMWRIGHAT PFFELKGHTDSVVALSFSNDGLLLASGGLDGVVRIWDASTGNLINVLDGPGGGI EWVRWHPKGHLVLAGSEDYSTWMWNADLGKCLSVYTGHCESVTCGDFTPDGKAI CTGSADGSLRVWNPQTQESKLTVKGYPYHTEGLTCLSISSDSTLVVSGSTDGSV HVVNIKNGKVVASLVGHSGSIECVRFSPSLTWVATGGMDKKLMIWELQSSSLRC TCQHEEGVMRLSWSLSSQHIITSSLDGIVRLWDSRSGVCERVFEGHNDSIQDMV VTVDQRFILTGSDDTTAKVFEIGAF | 241 | 1452 |
| 466 | WD40 repeat protein | MPVFRTAFNGYAVKFSPFVETRLAVATAQNFGIIGNGRQNVLELTPNGIVEVCA FDSSDGLYDCTWSEANENLVVSASGDGSVKIWDIALPPVANPIRSLEEHAREVY SVDWNLVRKDCFLSASWDDTIRLWTIDRPQSMRLFKEHTYCIYAAVWNPRHADV FASASGDCTVRIWDVREPNATIIIPAHEHEILSCQWNRYNDCMLVTGSVDKLIK VWDIRTYRTPMTVLEGHTYAIRRVKFSPHQESLIASCSYDMTTCMWDYRAPEDA LLARYDHHTEFAVGIDISVLVEGLLASTGWDETVYVWQHGMDPRAC | 223 | 1173 |
| 467 | WD40 repeat protein | MDSRNRRSRLNLPPGMSPSSLHLETTAGSPGLSRVNSSPSTPSPSRTTTYSDRF IPSRTGSRLNGFALIDKQPQPLPSPTRSAAEGRDDASSSSASAYSTLLRNELFG EDVVGPATPATPEKSTGLYGGSRDSIKSPMSPSRNLFRFKNDHGGNSPGSPYSA STVGSEGLFSSNVGTPPKPARKITRSPYKVLDAPALQDDFYLNLVDWSSNNVLA VGLGTCVYLWSACTSKVTKLCDLGVNDSVCSVGWTPQGTHLAVGTNIGEVQIWD TSRCKKVRTMGGHCTRAGALAWSSYILSSGSRDRNILHRDIRVQDDFIRKLVGH KSEVCGLKWSYDDRELASGGNDNQLLVWNQQSAQPLLRFNEHTAAVKAIAWSPH QHGILASGGGTADRCLRFWNTATDTRLNCVDTGSQVCNLVWCKNVNELVSTHGY SQNQIMVWRYPSMSKLATLTGHTLRVLYLAISPDGQTIVTGAGDETLRFWSIFP SPKSQSAVHDSGLWSLGRTHIR | 251 | 1777 |
| 468 | WD40 repeat protein | MERKKVVVPIVCHGNSRPIVDLFYSPVTPDGLFLISASKDSSTMLRNGETGDWI GTFEGHKGAVWSCCLDNRALRAASGSADFSAKIWDALTGDELHCFVHKHIVRAC AFSESTSLLLTGGHEKILRIFDLNRPDAPPKEVDNSPGSIRTVAWLHSDQTILS SNSDAGGVRLWDLRTEKIVRVLETKSPVTSAEVSQDGRYITTADGNSVKFWDAN HFGMVKSYTMPCMVESASLEPTMGNMFVAGGEDMWVRLFDFHTGEEIACNKGHH GPVHCVRFAPGGESYSSGSEDGTIRIWQTLNMNSEENESYGVNGLSGKVRVGVD DVVQRVEGFQITADGHLNDKPEKPNP | 367 | 1419 |
| 469 | WD40 repeat protein | MERYSQGTQKKSEIYTYEAPWQIYGMNWSVRKDKKFRLGIGSFLEEYNNRVEII ELDEESGEFKSDPRLAFDHPYPTTKIMFVPDKECQRPDLLATTGDYLRIWQCVE DRVEPKSLLNNNKNSEFCAPLTSFDWNDADPKRIGTSSIDTTCTIWDIEKEVVD TQLIAHDKEVYDIAWGEVGVFASVSADGSVRVFDLRDKEHSTIIYESSQPETPL LRLGWNKQDPRFIATILMDSCKVVILDIRFPTLPVAELQRHQASVNTIAWAPHS PCHICTAGDDSQALIWELSSVSQPLVEGGGLDPILAYTAAAEINQLQWSSMQPD WVAIAFSNEVQILRV | 284 | 1303 |

TABLE 15-continued

Peptide Table.

| Protein SEQ ID | Target | Patent PEPTIDE Sequence | Patent ORF start | Patent ORF stop |
|---|---|---|---|---|
| 470 | WD40 repeat protein | MQSENNLDESLHLREVQELQGHTDTVWAVAWNPVTGIDGAPSMLASCSGDKTVR IWENTHTLNSTSPSWACRAVLEETHTRTVRSCAWSPNGKLLATASFDATTAIWE NVGGEFECIASLEGHENEVKSVSWSASGMLLATCGRDKSVWIWDVQPGNEFECV SVLQGHTQDVKMVQWHPNRDILVSASYDNSIKVWAEDGDGDDWACMQTLGNSVS GHTSTVWAVSFNSSGDRHVSCSDDLTLMVWDTSINPAERSGNAGPWKHLCTISG YHDRTIFSVHWSRSGLIASGASDDCIRLFSESTDDSVTPVDGTSYKLILKKEKA HSMDVNSVQWHPSEPQLLASASDDGRIKIWEVTRINGLANSH | 684 | 1784 |
| 471 | WD40 repeat protein | MKRAYKLQEFVARASNVNCLKIGKKSSRVLVTGGEDHKVNNWAIGKPMAILSLS GHSSAVESVTFDSAEALVVAGAASGTIKLWDLEEAKIVRTLTGHRSNCISVDFH PFGEFFASGSLDTNLKIWDIRRKGCIHTYKGHTRGVNSIRFSPDGRWVVSGGED NIVKLWDLTAGKLMHDFKCHEGQIQCMDFHPQEFLLATGSADRTVKFWDLETFE LIGSAGPETTGVRANIFNPDGRTLLTGLHESLKVFSWEPLRCYDAVDVGWSKLA DLNIHEGKLLGCSYNQSCVGVWVVDISRVGPYAAGNVSRTNGHNEAKLASSGHP SVQQLDNNLKTNMARLSLSHSTESGIKEPKTTTSLTTTEGLSSTPQRAGIAFSS KNLPASSGPPSYVSTPKKNSTSRVQPTTNFQTLSRPDIVPVIVPRSNSLRPETT SDVKKEMNNFGRVVPSTVSTKSTDVIKSGSNRDESDKIDSINQKRMTGNDKTDL NIARAEQHVSSRLDNTNTSSVVCDGNQPAARWIGAAKFRRNSPVDPVVSPHDRS PTFPWSATDDGVTCQPDRQVTAPELSKRVVEPGRARALVASWETREKALTADTP VLVSGRPPTSPGVDMNSFIPRGSHGTSESDLTVSDDNSAIEELMQQHNAFTSIL QARLTKLQVIRRFWQRNDLKGAIDATGKMGDHSVSADVISVLIERSEIFTLDIC TVILPLLTRLLQSETDRHLTVAMETLLVLVKTFGDVIRATISATPTIGVDLQAE QRLERCNLCYVELENIKQILVPLIRRGGAVAKSAQELSLALQEV | 336 | 2738 |
| 472 | WD40 repeat protein | MSTLEIEARDVIKIVL0FCKEMSLHQTFQTLQNECQVSLNTVDSLETFVADINS GRWDVILPQVAQLKLPRKKLEDLYEQIVLEMIELRELDTARAILRQTQAMGFMK QEQPERYLRLEHLLVRTYFDPREAYHESSKEKRRSQIAQALASEVTVVPPSRLM ALIGQSLKWQQHQGLLPPGTQFDLFRGTAAVKADEEEMYPTTLAHTIKFGKQSH PECARFSPDGQYLVSCSVDGFIEVWDYISGKLKKDLQYQADDSFMMHDDAVLCV DFSRDSEMLASGSQDGKIKVWRIRTGQCLRRLERAHSQGVTSLSFSRDGSQLLS TSFDSTARIHGLKSGKALKEFRGHTSYVNDAIFTSDGGRVITASSDCTVKVWDV KTTDCIQTFKPPPPLKGGDVSVNSVHLFPKNSEHIVVCNKASSIYIMTLQGQVV KSFSSGKREGGDFVAACISPKGEWIYCVGEDRNIYCFSQQSGKLEHLMKAHDKD IIGVTPHPHRNLLVTYSEDSTMKIWKP | 81 | 1622 |
| 473 | WD40 repeat protein | MDIELEDQPFDLDFHPSAPIVAVALITGRLQLFRYVDISSEPERLWTVTAHTES CRAARFINAGSSVLTASPDCSILATNVETGQPVARLDNAHGAAINCLTNLTEST IASGQENGIIKVWDTRQNSCCNKFKAHEDYISDMEFVPDTMQLLGTSGDGTLSV CNLRKNKVHARSEFSEDELLSVALMKNGKKVVCGSQEGVLLLYSWGYFKDCSDR FVGHPHSVDALLKLDEDTVLTGSSDGIIRVVSILPNKMIGVIGEHSSYPIERLA FSHDRNVLGSASHDQILKLWDIHYLHEDDEPETNKQEAVNDENVDMDLDVDTEK RPRGSKRKKRAEKGQTSSQKQSSDFFADI | 399 | 1460 |
| 474 | WD40 repeat protein | MDRIQQIPHTCVARKINLPLGMSKESLALNLPANLAPTMSPPSITYSDRFIPSR KASNFEEFALPDETSPSPNSAGGQSSSTNGEGRDDACAAYSALLRTELFPATPD KTEGCRRPVIGSPSGNVFRFKSQQCKSQSPFSLCPVGEDGDLSETGAVARKTTR EIPRSPFKVLDAPALQDDFYLNLVDWSSHNILAVGLSACVYLWSASSSKVTKLC DLGLDDNVCSVAWTQRGTYLAVGTNNGGVQIWDAAHCKQVRTMEGHCTRVGTLA WNSHILSSGGRDNILQRDIRAQDDFVSKFSGHKSEVCGLKWSYDNRELASGGN DNQLFVWNQQSQQPVLKYNEHTAAVKAIAWSPHQHGLLASGGGTADRCIRFWNT ATNTSLNCVDTGSQVCNLVWSKNVNELVSTHGYSQNQIIVWRYPTMSKLATLTG HTLRVLYLAISPDGQTIVTGAGDETLRFWNVFPSSKTQQNTIRDMGVWSSGRTH IR | 207 | 1673 |
| 475 | WD40 repeat protein | MAGGQGEGEEKVDKLSMELTEDVMKSMEIGAVFKDYNGKINSLDFHRTNNYLVT ASDDEAIRLFDTASATWQKTSYSKKYGVDLICFTNHQTSVLYSSKNGWDESLRH LSLMDNKYLRYFKGHHDRVVSLCMSPKGECFMSGSLDRTVLLWDLRIDECQGLI RVRGRPAVAYDEQGLVFAISNEGGLIKMFDARLYDKGPFDTFVVEGDKSEASGI KFSNDGKLILLSTMDSNIHVLDAYQGTTVHSFSVEAVPNGGEAVPNGGTLEASF SPDGKFVISGSGNGNIHAWSVNSGREVACWTTEGVIPAVVKWAPRRLMFASGSS VLSLWVPDLSELASLTGSNSNSAY | 263 | 1309 |
| 476 | WD40 repeat protein | MHRVGSTGNTSNSSRPRREKRLTYVLNDANDSRHCSGINCLVISKLSLLGGNDY LFSGSRDGTLKRWELADDSAVCSATFESHVDWVNDAVLTGETLVSCSSDTTLKT WRPFSDGVCTRTLRQHSDYVTCLAAASKNSNIVASGGLGREVFIWDIEAAMAPV SRTSEAMDDDTSNGVLSSGNSVLSTTVRSTNATNSASLHTSQLQGYTPIAAKGH KESVYALANNDVGTLLVSGGTEKVVRVWDPRSGAKQMKLRGHTDNVRALILDST GRFCLSGSSSDSIIRLWDLGQQRCVHSYAVHTDSVWALASTPNFSHVYSGGRDLS LYLTDLTTRESLLLCMEKHPLLRLTLQDDSIWVATTDSSLHRWPAEGQNPPKMF QRGGSFLAGNLSFTRARACLEGSAPVPVNTQPSFVIPGSPGIVQHEILNNRRHV LTKDAEGTVKLWEITRGAVLDDYGKVSFEEKKEELFEMVSIPAWFTMDTRLGSM SVHLDTPQCFTAEMYAVDLNVPDAPEEQKINLAQETLRGLLAHWLSRRRQRLAT QASANGDFPAGQENALRNHISSRIDVHDDAETHIAGILPAFDFSTTSPPSIITE | 232 | 2529 |

TABLE 15-continued

Peptide Table.

| Protein SEQ ID | Target | Patent PEPTIDE Sequence | Patent ORF start | Patent ORF stop |
|---|---|---|---|---|
| | | GSQGGPWRKKITDLDGTEDEKDFPWWCLECVLHGRLSPRESLKCSFYLHPYEGT TVQVLTQGKLSAPRILRIQKVINYVLEKNVLDRPLDSSNSETTFTPGLSGNQSH AAVVGDGSLRSGARVWQQKAKPLVEILCNNQVLSPDMSLATVRTYIWKKPDDLY LYYRLVQNR | | |
| 477 | WD40 repeat protein | MMKGKTIQMQAAHQNHDGETSVACVLWDWHAKHLITAGADNTILIHSYPSSSSS KPITLRHHKNAVTALAINSNVRSLASGSVDHSVKLYSYPGGEFQSNVTRFTLPI RSLAFNKSGELLAAAGDDEGIKLISTIDNSIARVLKGHNGPVTSISFDPKNEFL ASSDSDGTVIYWELSTGKPVHTLKKIAPNTTSNPTSLNQISWRPDGEMLAVPGR KSSVSMYDRDTAEKLFSLKGGHSDTICSLAWSPNGKYIATAGTDRQVMVWDADR RQDIDKQRFDNPICSVAWRPSDNALAVIDVLGRFGVWESPIASHMKSPADGAER YDNMEDEEPLMARYEEELEDSVSGSLNEIINDDDDDDEMGKIPRKILQKKPSVK VEKGKEESWAKAFRSGQDSFKLKSANQEAFQPGATQRQSGKRNFLAYNNLGSVI TFDNDGFSHIEVDFPHDIGRGCRVPSMTDYFGFTMASLSESGSVFGSPQKGEKNP STLMYRPFSSWANNSEWSMRFPMGEEVKAVALGSGWVAAVTSLNFLRVFSEGGL QKFVLSMDGPVVTAAGYENLLVVVSHASNPLLSGDQVLSFTVYDISQKTCPLSG RLPLSPGSHLTWLGFSEEGLLSSYDSEGNLRVFTNDYNGCWVPIFSAARERRSE TESIWNVGLNSTQVFCVVCKLPDTYPQVAPKPVLSVLNLSLPLACSDLGADDLE NEYLRGSLLLSQMQKKAEDAVACGRESNMEEDSIFKMEAALDRCLLRLIANCCK GDRLVRATELARLLSLERSLQGAIELVSAMRLPMLAERFNTILEERILQENMET ISCRRLTSEAQDMDTPISISVKQVSYGANLGDSPFLPNRQVEPKHSTPVFSRPD TICEVDTSEAIAKGCDAQNGNIKSGDAEVQPASHNDSIQKPSNPFARASNTSAN QAVQRNASLLSSIKQMKTATENEGKRKERARSGSLPQKPAKQSKIS | 56 | 2950 |
| 478 | WD40 repeat protein | MRQKRKGHQVDDPKYSVQTPQEDDTPNESGPASEEVESSDEEGGNSSNIEDDII YSSSEEDPVVSSDYEEDEDAESDAEGVTAEQELEGDIDNALQNYMGTLTVLSNF HGENLKNAEGEDTSGDDDDEEEMPKRAEESDPEDENDERPKRAEESDFSEDED EERPKRAEESDSSEDEVPSRNTVGDVPLRWYKDEQHIGYDIKGKRIKKQPKKDQ LDSFLASTDDSSDWRKVYDEYNDEEVELTKDEIKFISRLRRGTIPHADVNPYEP YVDWFDWKDKGHPLSMAPEPKRRFIPSKWEAKRVVKLVRAIRKGWITFQKAEEK PRFYLMWGDDLKPSEKMANGLSYIPAPKPRLPGHEESYNFPPEYIPTQEEINSY QLMYEEDRPKFIPKRFDSLRNVPAYDRFLSEIFERCLDLYLCPRTRKKRINIDP ESLIPKLPKFKDLQPFPSICFLEYKGHTGAVSCISPESSGQWLASGSKDGTVRI WEVETARCLKVWDIGRPIQHIAWNPVSQLSILAVAVDEEVLVLNTGLGSEDSQE KVAELLHVKSKPVSADDLGDNTSLTRWIKHEKFDGIKLTHLKPVHLISWHHKGD YFATVAPDGNTRAVLVHQLSKQQTQNFFKKMQGRVVHVLFHPSRAIFFVATKTH VRVYDLVKQQLVRRLVTGLHEVSSMAVHHKGDNLLVGSKEGKVCWFDHDLSTQP YKTLKNHSKDIHSVAFHDSYPLFASCSDDCKAYVFYGLVYSDLLQNFLIVPLKV LQGHQSVNGMGVLDCQFHPKQPWLFTAGADSVVKLYCN | 193 | 2577 |
| 479 | WD40 repeat protein | MMSLRRGFEESLVPAKRQKTELSTVTYGDGPRRTSSLESPIMLLTGHHAAIYTM RFNPTGTVIASGSHEREIFLWNVHGDCRNFMVLKGHRNAVLDLHWTTDGCQIIS ASPDKTLRAWDVETGRQIRKMAEHSSFVNSCCPSRRGPPLVVSGSDDGTAKLWD LRHRGAIQTFPDKYQITAVGFSDAADKIYSGGIDNEIKVWDLRRGEVTMRLQGH TDTITGMQLSSDGSYLLTNSMDCSLRIWDMRPYAPQNRCVKILTGHQHNFEKNL LKCSWSSDGSKVTAGSADRMVYIWDTTTRRILYKLPGHTGSVNETGFHPTQPII GSCSSDRQIYLGEIEPNVGYQAVI | 187 | 1233 |
| 480 | WD40 repeat protein | MEFSDTYKHTGPCCFSPDARYLAIAVDYRLVIRDVVTLKVVQLYSCMDKISNIE WALDSEYILCGLYKRAMVQAWSLSQPEWTCKIDEGPAGIAHARWSPDSRHIITT SDFQLRLTVWSLVNTACIHIQWPKHASKGVSFTQDGKFAAIATRRDCKDYVNLL SCHTWEVMGTFTVDTIDLADLEWSPNDSAIVVWDSPLEYKVLIYSPDGRCLFKY QAYDSWLGVKTVAWSPCSQFLAVGSYDQTLRTLNHLTWKPFAEFVHVSTVRGPA SAVVFKEVEEPWNLDVSGLHLNDDNAHDIQDGKPAEGHSRVRYKVVEFPVNVSS QRHPVDKPNPKQGIGLLAWSRDSQYLFTRNDNMPTALWIWDICRLELAALLIQK EPIRAAAWDPVYPRVALCTGSSHLYMWTPSGACCVNIPLPQFVVSDLKWNPDGT SMLLKDRESFCCTFVPMLPEFNDDETNEE | 51 | 1436 |
| 481 | WD40 repeat protein | MAKLIETHSCVPSTERGRGILIAGDAKTNSIIYCNGRSVIMRNLDNPLEASVYG EHSYPATVARFSPNGEWVASGDTSGTVRIWGRGSDHTLKYEYKALAGRIDQLEW SADGQRIVVCGDSKGKSMVRAFMWDSGTNVGEFDGHSRRVLSCSFKPTRPFRVA TCGEDFLVNFYEGPPFRFKTSHRDHSNYVNCVRFAPDGSKFITVGSDRKGVIFD GKMGEKIGELSKEGGHTGSIYAASWSPDSKQVLTVSADKSAKIWEISETGNGTV KKTLTFGSQGGADDMLVGCLWLNDYLITVSLGGIVSLLSAVDPDKPPKTISGHM KSINAIALSLQSGQSEVCSSSYDGVIVRWILGVGYAGRVERKDSTQIKCLATIE GELVTCGFDNKVRRVPLLSEQHKESEPIDIGAQPKDLDVAVGCPELTFVSTDAG IIIIIRASKIVSTTNVGYAVTAAAISPDGTEAVVGGQDGRLRVYSIKGDTLLEES VLERHRGPINAIRFSPDGSMFASGDLNREAVVWDRITREVKLKNMVYHTARINC IAWSPDSSKVATGSLDTCILIYEVGKPASSRITIKGAHLGGVYGLAFSDQSTVI SAGEDACVRVWSLP | 525 | 2351 |

TABLE 15-continued

Peptide Table.

| Protein SEQ ID | Target | Patent PEPTIDE Sequence | Patent ORF start | Patent ORF stop |
|---|---|---|---|---|
| 482 | WD40 repeat protein | MPQPSVILATAGYDHTVRFWEATSGRCYRTLQYPDSQVNHLEITPDKQYLAAAG NPHIRLFEVNSNNPQPVISYDSHTNNVTAVGFQCDGKWMYSGSEDGTVKIWDLR APGFQREYESRAAVNTVVLHPNQTELISGDQNGNIRVWDLNANSCSCELVPEDT AVRSLTVMWDGSLVVAANNHGTCYVWRLMRGTQTMTNFEPLHKLQAHMSYILKC LLSPEFCEHHRYLATTSSDQTVKIWNVDGFTLERTLTGHQRWVWDCVFSVDGAF LVTASSDSTARLWDLSTGEAIRTYQGHHKATVCCALHDGTDGASC | 152 | 1099 |
| 483 | WD40 repeat protein | MLTKFETKSNRVRGLSFHPKRPWILASLHSGVIQLWDYRNGTLIDKFDEHDGPV RGVHFHKTQPLFVSGGDDYKIKVWNYKMRQCLFTFVGHLDYIRTVHFHNEYPWI VSASDDQTIRLWNWQSRVCISVLTGHNHYVNSASFHPKEDLVVSASLDQTVRVW DISGLRKKTVSPADDLSRLAQMNTDLFGGGDVVVKYVLEGHDRGVNWAAFHTSL PLIVSGADDRQVKLWRMNDTKAWEVDTLRGHTNNVSCVIFHARQDIIVSNSEDK SIRVWDMSKRTSVQTFRREHDRFWILAAHPEMNLLAAGHDSGMIVFKLERERPA YVVYGGSLLYVKDRYLRTYEFATQKDNPLIPIRKPGSIGPNQGFRSLSYSPTEN AILICSDADGGAYELYAVPKDSHGRSDTVQEAKKGLGGSAVFVARNRFAVLDKN HNQVTIKNLKNEVTKKFDLPVTADALFYAGTGNLLCRSEDSVFLFDMQQRTVLG EIQTPNVRYVVWSNDMENVALLSKHTIIIASKKLSSTCSLHETIRVKSGAWDDN GIFMYSTLNHIKYCLPNGDSGIIKTLDVPVYITKVSGKSLYCLDRDGKNRVIQI DITECLFKLALSKKKYDYVINMIRNSQLCGQAIIAYLQQRGFPEVALHFVRDER TRFNLAVESGNIEIAVASAKEIDEKDHWYRLGVEALRQGNAGIVEYAYQRTKNF ERLSFLYLITGNLDKLSKNLRIAEMKNDVMGQFHNALYLGDIQERIRILEESGE LHLAYATASLHGLADIADRLAADLGGNIPVLPPGKKSSLLMPPAPILHGGDWPL LRVTRGIFEGGLENSTSAAYEEEDEEAAADWGEDIDIENIEGENGEATVLDDQE VKGGEDDEGGWDMEDLELPPDVAAANVGTNQKTLFVAPTLGMPVSQIWMQKSSL AGEHAAAGNFETALRLLTRQLGIKNFSPLKPLFLELYMGSHTFLPSFASVPAFS LALQRGWSESASPNIRGPPALVYRLSVLEEKLTVAYRATTEGRFSEALRLFLNI LETIPVIVVDSRKEIDEVKELIGIAKEYVLGLRMEVKRKEIRDDAVRQQELAAY FTHCNLQKAHLKLALLNAMGISYRCKNYNTAANFARRLLETDPSSNHATKARQV LQVCERNLQDATQLNYDFRNFFVVCGATFTPIYRGQKEVSCPYCMARFVPDIAG KLCSICDLAIVGSDASGLFCFATQTR | 470 | 4114 |
| 484 | WD40 repeat protein | MDLLQNYQDDSEDSNPELRNHPPLEDATATSAPAGVENETSSSPDSSPLRLALP AKSCAPDVDETLMALGVPGSEKKNNHNKPIDPTQHSVTFNPSYDQLWAPLYGPA HFYAKDGIAQGMRNHKLGFVEDSAIEPFMFDEQYNTFHRYGYAADPSASLGSHI VGDLESLKKNDGASVYNLPKREHKRQKLEKKMIQKDENEEEEKEVGEEVDNPST EEWLKKNRKSPWAGKKEGLQTELTEEQKKYAQEHAEKKGDREKGEKVEIVDRTT FHGKEERDYQGRSWIDPPKDAKATNDHCYIPKRWVHTWSGHTRGVSAIRFFPKY GHLLLSAGMDTKVKIWDVFNSGKCMRTYMGHSKAVRDISFSNDGSRFLSAGYDR NIKLWDTETGKVISTFSTGKIPYVVKLHPDEDKQNVLLAGMSDKKIVQWDMNSG EITQEYDQHLGAVWTITFVDNNRRFVTSSDDKSLRVWEFGIPVVIKYISEPHMH SMPSISLHPNTNWLAAQSLDNQILIYSTRERFQLNKKKRFAGHIAAGYACQVNF SPDGRFVMSGDGEGRCWFWDWKTCKVFRTLKCHD14VCIGCEWHPLEQSKVATCG WDGMIKYWD | 196 | 2007 |
| 485 | WD40 repeat protein | MARKGLGTDPAIGSLMSSKRRKEYKVTNRFQEGKRPLYAIAFNFIDARYHNIFA TAGGTRVTIYQCLEGGAISVLQAYVDDDRDESFYTLSWACDVNGSFLLVAGGHN GIIRVLDVANEKVHKSFVGHGDSVMEIRTQALKPSLILSASKDESVRLWNVQTG ICILIFAGAGGHRNEVLSVDFHPSDVYRIASCGMDNTVKIWSMKEFWTYVEKSF TWTDLPSKFPTKYVQFPVPIAAVHSNYVDCTRWLGNFILSKSVDNEVVLWEPYS KEQSTSDGVVDILQKYPVPECDIWFIKFSCDFHYNSMAVGNREGKVYVWELQSS PPNLIARLSHAHCKNPIRQTAISHDGSTILCCCDDGSMWRWDVVQ | 214 | 1323 |
| 486 | WD40 repeat protein | MESGAGGSVGARVPSAKPEMLQQPPYSNGDDDNDMERGTAPVPSSNPNTVSKWE LDKDFLCPICMQTMKDAFLTACGHSFCYMCIMTHLNNKSNCPCCSLYLTNNQLF PNFLLNKLLKKTSACQMASTASPVENLCLSLQQGAEVSVKELDFLLTLLAEKKR KMEQEEAETNMEILLDFLQRLRQQKQAELNEVQKDILHYIKQDILALEKRRLELS RARERYSRKLHMLLDDPMDTTLGHAAIDDGNNVRTAFVRGGQGDAISGKFQQKK AEIKAQASSQGMQKRANFCHSDSQVLPTLSGLTIARKRRVLAQPDDLQECYLQK RRRWATQLRKQCDGGLRKERDGNSISREGYHAGLEEFQSILTTFTRYSRLRVIS ELRHGDLFHSANIVSSIEFDRDDELFATAGVSRRIKVDFATVVNEPADVHCPV VEMSTRSKLSCLSWNKCIKSQIASSDYEGIVTVWDVNTRQSVMMYEEHEKRAWS VDFSRTEPTRLISGSDDGKVKVWCTRQETSVLNIDMKANICCVKYNPGSSYYVA VGSADHHIHYYDLRNPSVPLYEFNGHRKTVSYVKFISTNELASASTDSTLRLWD VRDNCLVRTFKGHTNEKNFVGLTVNSEYIACGSETNGVFVYHKAISKPAAWHQF GSPDLDDSDDDTSHFISAVCWKSESPTMLAANSQGTIKVLVLAP | 68 | 2146 |
| 487 | WD40 repeat protein | MANYVDSKKNFKCVPALQQFYTGGPFRLSSDGSFLVCACNDEVKVVDLATGSVK NTLEGDSELIVALALTPDNKYLFSASRSTQIKFWDLSSATCKRTWKAHNGPVAD MACDASGGLLATAGADRSILVWDVGGYCTHSFRGHQGVVTTVIFHPDPHCLLL FSGSDDATVRIWDLVAKKCISVLEKHFSTVTSLAISENGWNLLSAGRDKVVNIW DLRDYHCRATIPTYEPLEAVCVLPTGSRLVSVMNQSRALPENRKKSGAAPVYFL TVGERGIVRIWYSEGALCLYEQKSSDAIISSDKDELKGGFVSAVLLPLTQGVMC VTADQRFLFYNLDESDEGKCDLKVSKRLIGYNEEIVDLKFLGDEEKFLAVATNL | 874 | 3705 |

TABLE 15-continued

Peptide Table.

| Protein SEQ ID | Target | Patent PEPTIDE Sequence | Patent ORF start | Patent ORF stop |
|---|---|---|---|---|
| | | EQVRNYDLSSMTCVYELSGHTDIVLCLDTVVFSGHSLLASGSKDHTVRIWDTES KSCICVAAGHMGAVGAVAFSKKAKNFFVSGSSDRTIKVWSFASVLDFGGISKSI KLSSQAAVAAHDKDINSVAVAPNDSLICTGSQDRTARIWRLPDLVPVLVLRGHK RGVWCVEFSPVDQCVMTASGDKTIRIWALSDGSCLKTFEGHTASVLRASFLTRG TQFVSSGADGLLRLWTIKSNECIATFDQHEDKIWAMAVGKKTEMLATGGSDSLV NLWHDCTTTDEEEALLKEEEAALKDQELLNALADTDYVKAIQLAFELRRPYKLL NVFTELYSKGHAQDQIQKVIRELGNEELRLLLEYVREWNTKPKFAHVAQFVLFQ LFWVLPPKEIIEVQGISELLEGLIPYAQRHYSRIDRLMRSTFLLDYTLSSMSVL SPTETDLSSSNLLARTADPLHAQIDQFHPThFPEPNLTPIQSLLDSGNTDSVEV TARRAKKKRVSGNDSEKTTVAEVKIGDMENAFDEPDVADQGSSRKHKPASSKKR KSIAVGNASIKRIASGNAVTIALQV | | |
| 488 | WD40 repeat protein | MESSCSSMNSNRHSTEKRCLRPLQKQGASMNKHSSDRFIPARGSIDLDVARFMV TQKQKDNNDIHALSPSPSPSKKAYQKEMADTLLKNAGAADNNCRILSFNGKSST VSQGSQENVLANLSISRRARRYIPQSADRTLDAPDLLDDYYLNLLDWSSTNVLS TALGNTVYLWDASNSSISELLIADEEEGPVTSVSWAPDGSQIAVGLNNSVVQLW DSQSNKKLBALKGHHDRVGALSWNGPILTTGGLDGIIINHDVRTRDHIVQTYKG HTQEVCGLKWSPSGQQLASGGNDNLLYIWDKSMASHNPSSQYFHQLDEHCAAVK ALAWCPFQTNLLASGGGTSDGSIKFWNTQTGACLNTVDTHSQVCSLLWNRHERE LLSSHGLNQNQLTLWKYPSMVKITELTGHTARVLHMAQSPDGYTVASAAADETL KFWQVFGAPDASKKTKTKDTKGAFNMFHMHIR | 360 | 1754 |
| 489 | WD40 repeat protein | MLDEIVADEEEEFNIWRKNTPLLYDVVITHALEWPSLTVQWLPDRHQSPTKDYS LQKMIVGTHTSGDEPNYLMIAEVQMPLQYSEDGNVGGFESTEAKVHIIQQIMHE GEVNRAQYMPQNSFIIATKTVSSDVYVFDYTKHSSNAPQERVCNPELILKGHTN EGYSLSWSPLKEGQLLSGSNDAQICFWDINAASGRKVVEAKQIFKVHEGAVEDV SWHLKHEYLFGSVGDDCHLLIWDTRTAAPNKPQHSVVAHESEVNSLAFNPFNEW LLATGSADKTVKLFDLRKLSCSLHTFSNHTEEVFQIEWSPMNETILASSGGDRR LMVWDLRRIGDEQTSEDAEDGPPELIFIHGGHTSKISDFSWNLHDDWLIASVAE DNILQIWQMAENIYHDDADIL | 185 | 1384 |
| 490 | WD40 repeat protein | MTKEDHGESRDEMGERMVNEEYKLWKKNTPFLYDLVITHALEWPSLTVQWLPPS CEQQQQIIKQDDIDHPNTQMVILGTHTSDNEPNYLILAEVQLHDGTEDEDGDGD VKRPQDKMKPGTSGGAMGKVRILQQINHQKEVNRARYNPQKPTIIATKTVNADV YVFDYSKHPSKPPQEGRCNPELRLQGHESEGYGLSWSPLKEGHLLSASDDAQIC LWDITAATKAPKVVEANQIFRYHDGPVEDVAWHAIHDHLFGSVGDDHHLLLWDI RNDSEKPLHIVEAHQAEVNCLAFNPFNEWIVATGSADRTVALHDIRKLDKVLHT CAHHMEEVFQIGWSPQNGAILASCGSDRRLMVWDLSRIGDEQNPEDAEEEAPPEL LFIHGGHTSKISDFSWNPAEEWVIASVAEDNILQVWQMSEHIYNDDWDSPTA | 241 | 1533 |
| 491 | WD40 repeat protein | MAMAMGDENAADPVEEFNIWKKNTPFLYDLVITHALEWPSLTVQWLFDRHQSST ADYSLQKNIVGTHTSEDEFNYLMIAEVQIPLQNSEDNIIGGFESTEAKVQIIQK INHEGEVNKARYMPQNSFVIATKTVSSDVYVFDYSKHPSKAPQERVCNPELILK GHSNEGYGLSWSPLKEGYLLSGSNDAQICLWDINAAFGKKVLEANQIFKVHEGA VGDVSWHLKHEYLFGSVGDDCHLLIWQMRTAAPNKPQQSVIAHQSEVNSLAFNP FNEWLLATGSMDKTVKLFDLRKLSCSLHTFSNHTDQVFQIEWSFMNETILASSG ADRRLMVWDLARIGETPEDEEDGPPELLFVHGGHTSKISDFSWNLNDDRVIASV AEDNILQIWQMAENIYHDDEDML | 230 | 1435 |
| 492 | WD40 repeat protein | MGLFEPFRALGYITDGVPPFAVQRRGIETFVTLSVGKAWQIYNCAKLIPVLVGPQ MQRKIRALACWRDFTFAATGHDIAVFRRAHQVATWSGHKAKVTLLLSFGQHVLS VDLEGCLFIWAVAEVNQNKPFIGQIQLGEKFSPSCIMHPDTYLNKVLIGSEEGT LQLWNVNTRKKLYEFKGWGSSIRCCVSSPALDVVGIGCSDGKIHVHNLRYDEEI VTFMHSTRGAVTALSFRTDGQFLLAAGGSSGVISIWNLEKKKLQSVIKDAHDSS VCSLHFFANEPVLMSSATDNSIKNWIFDTTDGEARLLKYRSGHSAPPMCIRYYG KGRHILSAGQDRAFRIFSVIQDQQSRELSQGHVGKRAKKLKVKDEEIKLPPVIA FDAAEIRERDWCNVVTCHLDDPCAYTWRLQNFVIGEHILKPCLEDPTPVKSCSI SACGNFAVLGTEGGWLERFNLQSGISRGTYIDIGEKRQCAHNGAVVGLACDATN TLLISGGYNGDIKVWDFKGRELKFRWEIEVPLIKIVYHPGNGILATAADDMILR LFDVTAMRLVRIFVGHMDRVTDLCFSGDGKWLLSSSMDGTIRVWDIISSRQLNA MHMDSAVTALSLSPGMQMLATTHVGHNGIYLWANRMIYSKATDIEPFISGKQVV RVSMPTVSSKRESEEGDEKRTIVAESNVNKSDVSGSLIGDSYSAQLTPELVTLA LLPKAQWQSLVNLDIIKMRNKPIEPPKKPEKAPFFLPSLPTLSGERIFIPSSMN GDGDQDETRNDKTVFEARGKKLGGESLSFMQLLQSCAKIKDFTTFTNYLKGLSP SAVDMELRLLQIVDNENISETEHSVELQGIGMLLDYFVNEVSCNNNFEFVQALI RLFLKIHGETIRCQVSLQEKARKLLEIQSSTWERL0TSFQNARCMITFLSSSQF | 101 | 2857 |
| 493 | WD40 repeat protein | MIAAVCWVPKGVAKVLPDSAEPPTQEEIQELLKCNVVAESDDNEDSDEESEEMD TETDKNTDAVAKALAAANALGSQSSDFQRQHKVDDIANGLKELDMDHYDDEDEG IDIFGSGSLGNCYYPANDMDPYLVEQDDDDEDEIEDMTIKPSDLIILSARNEDD VSHLEVWIYEEETEEGGSNMYVHHDIILPAFPLSLAWLDCNLKCGEKGNFVAVG TMQPEIELWDLDVLDEVEPAVVLGGAVKDEASGKTTKLKKKKKNKQAVNFKEGS HTDAVLGLAWNMEYRNVLASASADKSVKIWDIVAEKCEHTMQPHTDKVQAVAWN | 43 | 1548 |

TABLE 15-continued

Peptide Table.

| Protein SEQ ID | Target | Patent PEPTIDE Sequence | Patent ORF start | Patent ORF stop |
|---|---|---|---|---|
| | | PNQATVLLSGSFDRSVIMMDMRAPTHSGIRWPVPADVESLAWDPHTDHSFMVSA EDGTVRGFDIRAAASTADPFDGKPMFILHAHDKAVCAISYNPAAPSLLTTGSTDK MVKLWDITNNQPSCIASTNPNVGAVFSAAFSKNSPFLLATGGSKGILHVWDTLD NSEVARRFGKFRPQN | | |
| 494 | WEE1-like protein | MIMDENEFCDIFSLRKRLCLLSSQEGEEFEELEAMSQLDAGEFTVTGWEEVVAI AEDDVNTGILSQDLFSSQDYCTPSQPQDSTDLDSRDKAPCPLSPVKSTIQRKRC RPELLSNPPDSIQFSFQRLERVRSEESIQSSSQQLARVRSEVSSSDDFKTPKIT ASGQKNYVSQSALALRARVMSPPCIKNPYLDENEELNERIQRSTRRSPACVTPI QSGACLSRYPADFHELEEIGRGNFSRVYKALNRLDGCCYAVKCSQSELRLDTER KVALMEVQSLAALGPHKNIVGYETAWFENDHLYIQMELCDHNLTTANDRGILRT DTDFLEAVYQIAQALEFIHGRGVAHLDVKPENIYVRDGTYKLGDFGRATLINGT LHVEEGDARYMSREILNDNYEHLDKVDMFSLGATFFFELLMRKQYPGSGKRIDRD TEIKIPILPGFSIYFQKLLQDLVSNDPGKRPSAKDVLKNPIFNKVRGAKEV | 206 | 1657 |
| 495 | WD40 repeat protein | MLAPALEMEPVEPQSLKKLSFKSLKRALDLFSPVEGQIAPPDPESKKMRISYKL NFEYGGGSGSEDQVPKRKESGAAQNQGQQAAGASNLALPGPEGSKIPPMEKSQ NALTVGPSLRPQGLNDVGLHGKGTAIISASGSSDRNLSTSAIMERLPSRWPRPV WHPPWKNYRVISGHLGWVRSIAFDPSNQWFCTGSADRTIKIWDLASGRLKLTLT GHIEQIRGLAVSSKHTYMFSAGDDKQVKCWDLEQNKVIRSYHGHLSGVYCLALH PTIDILLTGGRDSVCRVWDIRSKMQIFALSGHDNTVCSVFARPTDPQVVTGSHD TTIKFWDLRHGKTMTTLTNHKKSVRAMAQHPKENCFASASADNIKKFQLPRGEF LHNMLSQQKTIINTMAVMEEGVMATGGDNGSLWFWDWKSGHNFQQAHTIVQPGS LESEAGIYALSYDLTGSRLVSCEADKTIKMWKEDELATPETHPLNFKPPKDIRR F | 117 | 1580 |
| 496 | WD40 repeat protein | MEEAAKEQSAGSGKPKLLRYGLRSAAKPEEDKKEEQLHQPPPPPPQQQAAPAP APAATRSSTSGSAGGRDRRPQQQHAVDEKYARWKSLVPVLYDWLANHNLLWPSL SCRWGPQLEQATYKNRQRLYISEQTDGSVPNTLVIANCEVVKPRVAAAEHVSQF NEEARSPFIRKYKTIIHPGEVMRIRELPQNPNIVATHTDSPDVLIWDVESQPNR HAVYGATASRPNLILTGHQENAEFALAMCPAEPFVLSGGKDKTVVLWSIQDHIT ASATDQTTNKSPGSGGSIIKKTGEGNEETGNGPSVGPRGIYCGHEDTVEDVAFC PSTAQEFCSVGDDSCLILWDARIGTNPVAKVEKAHNGDLHCVDWNPHDNNLILT GSADNSVNMFDRRNLTSNGVGSPVYKFEGHKAAVLCVQWSPDKPSVFGSSAEDG LLNIWDYERVDKKVDRAPNAPAGLFFQHAGHRDKIVDFHWNTADPWTMVSVSDD CDTAGGGGTLQIWRMSDLIYRPEEEVLAELENFKAHVLECSKA | 111 | 1700 |
| 497 | WD40 repeat protein | MAKDEEEFRGEMEERLVNEEYKIWKKNTPFLYDLVITHALEWPSLTVQWLPDRE EPPGKDYSVQKMILGTHTSDNEPNYLMLAQVQLPLEDAENDARQYDDERGEIGG FGCANGKVQVIQQINHDGEVNRARYMPQNPFIIATKTVSAEVYVFDYSKHPSKP PQDGGCHPDLRLRGHNTEGYGLSWSPFKHGHLLSGSDDAQICLWDINVPAKNRV LEAQQIFKVHEGVVEDVAWHLRHEYLFGSVGDDRHLLIWDLRTSATNKPLHSVV AHQGEVNCLAFNPPFNEWVLATGSADRTVKLFDLRRISSALHTFSCHKEEVFQIG WSPKNETILASCSADRRLMVWDLSRIDEFQTPEDALDGPPELLFIHGGHTSKIS DFSWNPCEDWVIASVAEDNILQIWQMAENIYHDEEDDMPPEEVV | 144 | 1412 |
| 498 | Cyclin-dependant kinase inhibitor | MGKYMRKGKGVGEVAVMEVSQGSLGVRTRARTLAAASSQK0HRRLGASKSVTTK HQSSAPPASPCVESSMHTCYLELRSRKLEKFSRCYHSAHGATSHGESKRSLSLS EPSRLAVSEEARVASDKSSHRVLQQQSSVAHSRNNSATFSHNAKPAKAAQRKER RDDDNTSARPSEAPHEDEDGNEVEASFGENVMDLDSRFRRTRETTPSSYTRDVE TMFTPGSTTRPPSNAGRRRFQTEGGHGTRNQFHVPTTNEIEEFFAGAEQQEQRR FTDRYNYDPVSDSPLPGRFEWVRLRP | 793 | 1683 |
| 499 | CDK type D | MQNMEENVQSSWSLHGNKEICARYEILKRVSSGTYLDVYRGRRKEDGLIVALKE VHDYQSSWREIEALQRLCGCPNVVRLYEVILEFLTSDLYSVIKSAKNKGENGIP EAEVKAWMIQILQGLANCHANWVIHRDLKPSMMLISAYGILKLADFGSMSFLKR AIYEVEYELPQEDILADAPGERLMDEDDSVKGVWNEGEEDSSTAVETNFDDMAE TANLDLSWKNEGDMVMQGFTSGVGTRWYRAPDFLYGATIYGKEIDLWSLGCILG ELLILEPLFSGTSNIDQLSRLVKVLGLQQKKNWPGCSNLPDYRKLCFPGDGSPV GLKNHVPNCSDNMFSILERLVCYDPAARLNAKEIVENKYFVEDPYPVLTHELRV PSPLREENNFSFDWAKWKDMEVDSDLENIDEFNVVHSSDGFCIKFS | 415 | 2196 |
| 500 | Histone actyltransferase | MAPVKRIEPEKTKANEGKPKRRKVAFAIDTGIEANDCISLHLVSTPEEMRDAEG VEDQSLSFNPEYMQHFVGEHGKIYGYKGLKIDVWLNALSFHAYVDIQYESKVEE GKSEKEATDLTDIMKRIFGRGLVEDRNAFIQSFSSNSQSIESMIHNEGERIATR EILTDKGLSAQGDSERLGVSNEIFRLELSDPQIREWHARLEPLVLLFVEGSQPI EQDDPKWEMYIRVQRESLSGGSAVCRLLGFCTVYRFYHYPDTTRLRISQILVFP PYQGKGHGLLLLEAVNKTAVSRDSYDVTVEEPSESLQELRDCMDTIRLLSFEPV MPAVKSAVQKLKEANPSDKRCWEILLYLNLDRSDSQCEDKYHISLMEQIMSELFDKS SEKSAKGKRVIDIDNEYDNSKTFIMVRTRNPGNGEGFLPEALEGGMEVSQEDQL KSLFEERLEEIAQIAEKVPSLCKALQMP | 109 | 1653 |

TABLE 15-continued

Peptide Table.

| Protein SEQ ID | Target | Patent PEPTIDE Sequence | Patent ORF start | Patent ORF stop |
|---|---|---|---|---|
| 501 | Histone deacetylase | MPEDRKKILEALAAKRKAEAESGEKKKRQKSSLNPAKPVSKPVSKPVGGIGSKG KSTSAPISSTKAKSKHKEEVKAKRVTKNDRYETDEDDESEEEEDLDSESDDDEL SDEDSEDDIKSKSVKKLPPQSKGKAPVKGISSSNGKGRQEKGKGIMKDKGKAKA KVEESSSDAEGDSDDDGGDLSDDPLQEVDPSMILPSRTRRRASQPTNYQFANMS GDDDDDDSD | 343 | 1023 |
| 502 | Histone deacetylase | MADVPESLQQEKDSQGTDKNCCDGKFQKEIDIDDMEEEYNESSIDDEEENLSDN VATNNMGTIPQGQACMAVTVEGIEHANSVGCGRNGREGSEEVTAAEDMGHVSIE NIREQGRNRKSSEQLLALYEQEGLLEDDEDDDDVDWEPFEGVTVQMKWYCTNCT MANSDDSVHCDSCGEHRNSDILRQGFLASPYLPAESPSSSDVPDERLEESKCVM TTLTPSISPMIGVCCSSLQSERRTVVGFDERMLLHSEIQMETYPHPERPDRLRA IAASLRAAGLFPGKCFSIPAREATCEELQTIHSLEHVNAVESTSCGMLSHLSPD TYANEHSSLAARLAAGLCADLAKAINTGQAQNGFALVRPPGHHAGVKDSMGFCL HNNAAIAVSASRVVGAKKVLIVDWDVHHGNGTQEIFEADQSVVLYISLHRHGEGF YPGSGAVTEVGSSKGEGYSVNIPWKCGGVGDNDYIFAFQHAVLPIAEQFEPDLT IISAGFDAAKGDPLGRCEVTPDGFAHMAQMLSCLSKGKNLVILEGGYNLRSISA SATAVIKVLLGDNPKALPIDIQPSKGGLQTLLEVFEIQSKYWSSLKGHDQKLRS QWEAQYGSKKRKVIRKRHMHIVGPVWWKWGRKRVVYYHWFARVSSRKHL | 417 | 2351 |
| 503 | Peptidylprolyl isomerase | MASGAGAAGVVEWHQKPPNPIQJPVVFFDVTIGTIPAGRIKMELFADIVPRTAEN FRQFCTGEYRKAGIPIGYKGCHFHRVIKDFNIQAGDFVKGDGSGCISIYGSKFE DENFIAKHTGPGLLSMANSGPNTNGCQFFLTCAKCDWLDNKHVVFGRVLGEGLL VLRKIENVQTGQHNRPKLPCVIAECGEM | 69 | 641 |
| 504 | Peptidylprolyl isomerase | MAKLVSSVCAFSCQQRHPHSRPRFLSNRDHYNHYHNHSHYHNVCYFPPMMNNQQ QLQKQKRMTTKTITSLFKCNSSNHTLLKGLKEFMGFKFRLQAAMLSCEHSILGR VFAIFFIVHQAAAPFPFNHFDNWLVPPASAVLYSPNTKVPRTGEVALRKSIPAN PAMKSIQDFLEDIYYLLRFPQRKPYGTMEGDVKSALQIAINEKDSILGSVPLDM KERGLQLYNFLIDGQGGLQVLIEYIKEKDPDKVSVNLSSSLDTIAQLELLQAPG LPYLLPEEYQQYPRLNGRATIEFTMEKGDNSMFSVSSGGGLQRTATIQVVLDGY SAPLTAGNFTKLVIDGAYNGLKLKTTEQAVISDNERAEAGFNLPIEILPAGGFE PLYRTTLSVQDGELPVLPLSVYGAIAMAHNTISEDYSSPSQFFFYLYDKRNAGL GGLSFDEGQFSVFGYTTVGICEILPQLKTGDIIKSAKLVDGFDHLVLPSSST | 172 | 1623 |
| 505 | WD40 repeat protein | MDHYYQDDFDYLVDDEMVDFADDVEDDVRTRRRSDIDSDSENDFDSNNKSPDTT ALQAKRGKDIQGIPWNRLNFTREKYRETRLQQYKNYENLPRPRRSRNLDKECTN FERGSSFYDFRHNTRSVKATIVHFQLRNLVWATSKHNVYLMQNYSIMHWSSLKQ KGEEVLNVAGPIIPSVKHPGSSPQGLTRVQVSAMSVKDNLVVAGGFQGELICKY LDKPGVSFCTKISHDENGITNAVEIYNDASGATRLMTANNDLAVRVFDTEKFTV LERFSFPWSVNHTSVSPDGKLVAVLGDNADCLLADCKTGKTVGTLRGHLDYSFA AAWHPDGYILATGNQDTTCRLWDVRKLSSSLAVLICGRNGAIRSIRFSSDGRFMA MAEPADFVHLYDTRQNYTKSQEIDLFGEIAGISFSPDTEAFFVGVADRTYGSLL EFNRRRMNYYLDSIL | 231 | 1768 |
| 506 | WD40 repeat protein | MDCSGDEEFEQFFESLEEMLSPSDSGSEAADNETGCRNADARSKYEIWKRAPSS IQERRQRFLVRMGLANPSELGNQVNSTSAESTCSTETANIPNGIERLRENSGAV LRTAGSSGRKTHCKNVINIGLREGSVRSSSSSNGTPDVGEDNGEFGGTIFSRSG GTWECMCKIKNLDSGKEFVVDELGQDGLWNKLREVGTDRQLTMDEFERSLGLSP LVQELMRRESGVAQADCNGVHHHDAEISSSKRRSWLKALKSAAYSMRRPKEDQS NYDSERSGRRSGSFDVPWGKPQWTKVRHYRKRYKEFTALYMGQEIEAHEGSIWT MKFSLDGRYLASAGQDCVIHVREVIESMRTFGADTPDLYASSAYFSMNGLQELV PLSIEDHANKMKRGKIIGSKKSSNSDCIVLPNKVFQLSEEPVCSFHGHLLDVFD LSWSPSQYLLSSSMDKTVRLWKLGHESCLKVFSHNDIVTCIQFNPVDERYFISG SLDGKARIWSIPDRQWDWSDLREMVTAVCYTPDGQGGLVGSIKGSCRFYNTSG NKLQLENQLNVRSKKKKSSGKKITGFQFAPGGDSQKVLITSADSRVRVYNGSEL VCRYKGFRNTCSQISASFAPNGQHFVCASEDSRVYIWNHESPRGSGARHEKSSW SHEHFLSQGVSVAIPWSGMKLQPPVWNSPEFMLGQRHNLLSLQGGKDVGCQNGL LSREAGEGQESETPLHYISQVSHSCGSQNMVDRDGQDDLSRYSACISDSRLSSF MAPPESPGNPDDLNSKVFFSQSSSKGSATWPEEKLPPTRKQSRSNSTSSHYDTL KTHLGNTIQGQSGASAAVAWGLVIVTAGHGGEIRSFQNYGLPVRL | 376 | 2943 |
| 507 | WD40 repeat protein | MPSIPAIGEFTVCEINRELLTTKDESDTQAKDAYAKILGLVFPPISFQIEEGFG SASRQQFDQDLDREDTIVTPSTSEGTNALQEGGLLLKGVSVLKNILASSFGPIF SPNDTKVLKKVELLQGISWHRHKHILAFISGSNQVTVHDFQDPEWRESSLLVSE SQRGIEALEWRPNGGTTLSVACRGGICIWSASYPGSVAPVRSGVASFLGTSTRG SSVRWTLVDFLQIPGGKAVTALSWSPTGRLLASASREDSSFTIWDVAQGVGTPL RRGLGGISLLKWSPTGDYLFSAKPNGTFYLWETNTWTLEQWSSSGGCVISATWG PDGRNLFMAFSESTTLGSLHFAGRPPSLDAHLLPMELPEIGSITGGFGNIEKMA WDGCGERLAVSYTGGDLMYVGLIAIYDTRRTPFISASLVGFIRGPGEQVKPLAF AFHDKFKQGPLLSVCWSSGLCCTYPLIFRAH | 107 | 1498 |

TABLE 15-continued

Peptide Table.

| Protein SEQ ID | Target | Patent PEPTIDE Sequence | Patent ORF start | Patent ORF stop |
|---|---|---|---|---|
| 508 | WD40 repeat protein | MEEENAKHTEETRQVQVRFTTKLQPALRVPTTSIAIPAHLTRYGLSDIVNTLLG NDKPQPFDFLVESELVRTSLEKLLLIKGISAEKILNIEYILAVVPPKQEEPSLH DDWVSVVDGSYPNFIFSGSFDSIGRIWKGEGLCTHVLEGHRDAITSAAFIMPSD SSDSFINLATASKDRTLRLWQFKPNEHMTNGKMVRPYKLLKGHTSSVQTVSACP RRMLICSGSWDCSIKIWQTAGEMDIESNAGSVKRRKLEDSTEQIISQIEASRTL EGHSQCVSSVVWLEKDTIYSASWDHSVRSWDVETGVNSLTVGCRKALHCLSIGG EGSALIAAGGADSVLRIWDPRMPGTFTPILQLSSHKSWITACKWHPKSRHHLIS ASHDGTLKLWDVRSKVPLTTLEAHKDKVLCADWWKEDCVISGGADSTLQIFSNL NLT | 118 | 1425 |
| 509 | WD40 repeat protein | MNRLRSKRNHILELRLGQSEPERFATLASNRSRGTNAPIVVEDDDDVVVSSPRS FALARSSVSQRSSRIPIVNEEDLELRLGLAVTGRTSAEHNPRRRHGRVPPNKPI VLCDDAGEADQSSSKKRRTGQQLSSDVQSDESKEVKLTCAICISTMEEETSTIC GHIFCKKCITNAIHRWKRCPTCRKKLAINNIHRIYISSSTG | 186 | 797 |
| 510 | WD40 repeat protein | MEEPPPPAVLPSSEDTSIVSSHSFVNAPPTVPVGLDASIPQISTPGINQPGLTI PVPPEAAPLTASLVAASAGMPPAVVPSFVRPAIVAHPSVMPPPSMPLAALPMPV ASAVPVAAPHFPPSTPNDNSITPSMPVPTPIVASSSVPPSVTIPGIAPLPFIAP IPVPSSRPVAPSPFMPPARPLGASVSVAMDVDNTDEQDQDADNKGESPSSSPDH PEDPSAAEYEITEESRKVRERQEQAIQELLLRR8AYALAVPTNDSSVRARLRRL NEPITLFGEREMERRDRLRALMAKLDAEGQLEKLMKVQEEEEAAANVDAEEVQE MEGPQVYPFYTEGSQELLKARTEITKFSLPRAVSRLQRARRKREDPDEDEDEEL KCVLQQSAQINMDCSEIGDDRPLSGCAFSSDGTLLATSAWSGVTKLWSVPNINK VATLKGHTERVTDVAFSPTNCHLATACADRTANLWNSEGVLMKTYEGHLDRLAR LAFHPSGLYLGTASFDETWRLWDVNTGIELLLQEGHSRSVYGIAFQCDGSLAAT CGLDGLARIWDLRTGRSILALEGNVKPVLGIDFSPNGYHLATGSEDHTCRIWDL RKRQSVYIIPAHSHLVSQVKFEPQEGYFLVTASYDSTAKVWSARDFRSIKVLAG HEAKVTSVDITADGQYIATVSHDRTIKLWSSKNSTNDMNIG | 387 | 2456 |
| 511 | WD40 repeat protein | MKRAYKLQEFVAHASNVNCLKIGKKSSRVLVTGGEDHKVNMWAIGKPNAILSLS GHSSAVESVTFDSAEALVVAGAASGTIKLWDLEEAKIVRTLTGHRSNCISVDFH PFGEFFASGSLDTNLKIWDIRRKGCIHTYKGHTRGVNSIRFSPDGRWVSGGED NIVKLWDLTAGKLMHDFKCHEGQIQCMDEHPQEFLLATGSADRTVKFWDLETFE LIGSAGPETTGVRANIFNPDGRTLLTGLHESLKVFSWEPLRCYDAVDVGWSKLA DLNIHEGKLLGCSYNQSCVGVWVVDISRVGPYAAGNVSRTNGHNEAKLASSGHP SVQQLDNNLKTNMARLSLSHSTESGIREPKTTTSLTTTEGLSSTPQRAGIAFSS KNLPASSGPPSYVSTPKKNSTSRVQPTTNFQTLSRPDIVPVIVPRSNSLRPETT SDAKKEMNNFGRVVPSTVSTKSTDVIKSGSNRDESDKIDSINQKRMTGNDKTDL NIARAEQHVSSRLDNTNTSSVVCDGNQPAARWIGAAKFRRNSPVDPVVSPHDRS PTFPWSATDQGVTCQPDRQVTAPELSKRVVEPGRARALVASWETREKALTADTP VLVSGRPPTSPGVDMNSFIPRGSHGTSESDLTVSDDNSAIEELNQQHNAFTSIL QARLTKLQVIRRFWQRNDLKGAIDATGKMGDHSVSADVISVLIERSEIFTLDIC TVILPLLTRLLQSETDRHLTVAMETLLVLVKTFGDVIRATISATPTIGVDLQAE QRLERCNLCYVELENIKQILVPLIRRGGAVAKSAQELSLALQEV | 359 | 2761 |
| 512 | Cyclin B | MAGSDENNPGVVGGAHVQEGLRVGAGKMGAGNVQQRRALSNINSNIIGAPPYPC AVNKRVLSEKNVNSENDLLNAAHRPITRQFAAQMAYKQQLRPEENKRTTQSVSN PSKSEDCAILDVDDDKMADDFPVPMFVQNTEAMLEEIDRMEEVEMEDVAEEPVT DIDSGDKENQLAVVEYIDDLYMFYQKAEASSCVPPNYMDRQQDINERMRGILID WLIEVHYKFELMDETLYLTVNLIDRFLAVQPVVKKKLQLVGVTAMLLACKYEEV SVPVVEDLILISDRAYSRKEVLENERLMVNTLHFNMSVPTPYVFMRRFLKAAQS DKKLELLSFFIIELSLVEYDMLKFPPSLLAASAIYTALSTITRTKQWSTTCEWH TSYSEEQLLECARLMVTFHQRAGSGKLTGVHRKYSTSKFGHAARTEPANFLLDF RL | 238 | 1648 |
| 513 | Cyclin-dependant kinase inhibitor | MQAPREGKSAAAIVGMGKYMKKSKAIPRDVSLLEASPRSPSATGVRTRAKTLAS RRLRRASQRRPPPPAAAAAAAAPSLDASPCPFSYLQLRSRRLRRPRLAPSPEAR IDEGPAGSGSRGSRDASCSARTASSSGGVEGEGACVGRGDRGNGGECVRDAAVD ASYGENDLEIEDRDRSTRESTPCSLIRDSNANTPPGSTTRQQSSCTAHRTQMSI LRSIPTSDEMEEFFAYAEQRQQRSFIEKYNFDIVKDRPLPGRFEWVQVIP | 59 | 859 |
| 514 | Histone acetyltransferase | MDGHSSHLAAQNRSRGSQTPSPSHSAASASATSSIHLKRKLSAANASAASAAAA AAAAAAAADDHAPPFPPSSISADTRDGALTSNDDLESISARGGGAGDDSDDDSD DEEEDDGNDGGSSLRTFTAARLENVGPAAARNRKIKAESNATVKVEKEDSAKD GGNGAGVGALGPAATSGAGSGSGTVPESDAVKIFTENLQASGAYSAREENLKRE EEAGRLRFECLSNDGVDDHMVWLIGLKNIFARQLPNMPKEYIVRLVMDRNHKSV MVIRRNLVVGGITYRPYASQKFGEIAFCAIKADEQVKGYGTRLMNHLKQHARDV DGLTHFLTYADHNAVGYFIKQGFTKEIYLDKDRWHGYIKDYDGGILMECKIDPK LPYTDLSTMVRRQRQRQAIDEKIRELSNCHIVYQGIDFQKRDAGVPQNTIKMEDIP GLREAGWTPDQWGYSRFRGLSDQKRLTFFIRQLLKVLNDHSDAWPFKEPVDARE VPDYYDIIKDPMDLKTMKRVESEQYYVTLEMFIADVERNFANARTYNSPDTIY FKIATRLSAHFQSKVQSNLQSGAGKIQQ | 44 | 1829 |

TABLE 15-continued

Peptide Table.

| Protein SEQ ID | Target | Patent PEPTIDE Sequence | Patent ORF start | Patent ORF stop |
|---|---|---|---|---|
| 515 | Peptidyiprolyl isomerase | MFHGMMDPELFKLAQEQMNRNSPAELAKIQQQMMSHPELMRMASESMKNMRPED LRQAAEQLRHVRPEEMAEIGEKMANASPEEIAAVRARADAQMTYEINAAKILEE EGNELHSQGRFKDASQKYLHAKNNLKGIPSSEGKNLLLACSLNLMSCYLETRQY EECIEEGSEALACEEKNLKAFYRRGQAYRELGQLEDAVSDLRKAHEISFDDETI AQVLRDTEESLTEEGGSAPRGVVIEEITEEDETLASVNHESFSEYSEERHQESE DAHKGPINGDIMGQMTHSESLEALEGDPDAIRSFQNFISNADPTTLAAMGAGNA GEVSPDLIKTASSMIGEMSAEELQKMIQLASSFPGENPYVTRNSDSNSNSFGNG SIPNVSPDMLKTASDMNSEMSPDDLQRMFEMASSSRGKDPSLDAHHASSSSGAN LAANLNHILGESEPSSSYHIPSSSRNISSSPLSHFPSSPGDMQEQIRNQMEDPA MRQMFTSMMENMSPEMMANNGKQFGLELSFEDAAEAQEAMSSLSPEMLDKMMRW ADRAQRGVETAKRTKNWLLGRPGMILAICMLLLAVILHRLGFIGS | 109 | 1866 |
| 516 | WD40 repeat protein | MIAAISWVPRGASKAVFEVAEPPSKEEIEEILKSGVVERSGDSDGEEDDEHHDA VASEKADEVSTALSAADALGRISKVTKAGSGFEDIADGLRELDMDNYDEEDEDV KLFSTGLGDLYYPSNDMDPYLKDKDDDDTEEIEDLSIEPMDSLIVCARTDDEV NLLEVYLLEPSLSDESNMYVHHEVVISEFPLCTAWLDCPIKGGDKGNFIAVGSM EPAIEIWQLDIIDAVEPCLVLGGQEELEKEKEGKKASIKYKEGSHTDSVLGLA WNKEFRNILASASADRQVKIWDVAAGKCWITMEHHTDEVQAVAWNHHAPQVLLS GSFDHSVVMEDGRIPSHSGYRWSVTADVESLAWDPHSEHFFVVSLEDGTVRGFD VHAAISNSASQSLPSFTLHAHEKAVSTISYNPAAPNLLATGSTDEMVKLWDLSW WQPSCIASRNPKAGAVFSVSFSEDSPLLLAIGGSKGRLEVWDTSSDAAVSRRFG KHGEPETAEPGS | 212 | 1815 |
| 517 | WD40 repeat protein | MEFCEEYQEYMQGQEGEKLPGLGFRKLKEILERCRRRDSLHSQKALQAVQNPRT CFAHCSVCDGSFFPSLLEEMSAVLGCFNEQAQKLLELHLASGFQKYLMWFEGEL RGNHVALIQEGKDLVTYALINAIAIRKILEKYDEIHLSTQGQAFKSQVQRMEME ILQSPWLCELIAFHIWVRETEANSGEGHALFEGCSLVVDDGKPSLSCELFDSIE LDIDLTCSICLDTVFDSVSLTCGHIYCYMCACSAASVTIVDGLEAAEPKEKCPL CREARVFEGAVHLDELNILLSRSCPEYWAERLQTERVERVRQAREHWESQCRAF MGVE | 207 | 1193 |
| 518 | WD40 repeat protein | MVSTQSTRENPSIFFPPPLKPWLLPVVLSLSLSRQLGMAAAAASLPFKKNYRS SQALQQFYAGGPPFAVSSDGSPIACNCGDSIRIVDSSNASLRPSIDCGSDTITAL SLSPDGKLLFSAGHSRQIRVWDLSTSTCLRSWKGHDGPVMSMACPVSGGLLATG GADRKVMVWDVDGGFCTHFFKGHDGVVSTVLFHPDSNRSLLFSGSDDGTIRVWD LLAKKCASTLRGHDSTVTSLAFSEDGLTLLAAGRDKVVSLWDLHNYACKKTIPM YEVLESVCVIHSGTVLASQLGLDDQLKVTKESAQNIHFITVGERGILRIWKSEG SVCLFHQEHSDVTVISDEDDSRSGFTAAVMLPLDQGLLCVTADQQFLFYYPEKH PEGIFSLTLCRRLVGYNEEIVDMKFLGEEENFLAVATNLEQVRVYELASMSCSY VLAGHTETVLCLDTCISSSGRTLIVTGSKDNSVRLWDSESRHCIGVGVGHMGAV GAVAFSRKRQDFFVSGSSDRTLKVWSLDGISEDGVDSTNLKAKAVVAAHDKDIN SVAVAPNDSLVCSGSQDRTACVWRLPDLVSVVVLKGHKRGIWSVEFSPVDQCVL TASGDKTVKIWAISDGSCLKTFEGHVSSVLRASFLTRGTQFVSCGADGLVRLWT VRTNECIATYDQHSDRVWALAVGKKTEMLATGGSDAVVNLWYDSTASDKEDAFR KEEEGVLKGQELENAVSDADYTKAIELALELRRPHKLFELFSELCRTREVGDRV ERILSALSGEEVCLLLEYIREWNAKPRLCHVAQSVLSQVFRILSPTEIVEIKGI GELLEGLIPYSQRHFSRIDRLVRSTYLLDYTLTGMSVIEPEADRSAVNDGSPDK SGLEKLEDGLLGENVGEERIQNREELESSAYRRRRLPRSKDRSRKKSKNVVYAD AAAISFRA | 6 | 2786 |
| 519 | WD40 repeat protein | MDSAPRRRSGGINLPSGMSETSLRLDGFSGSSSSFRAISNLTSPSKSSSISDRF IPCRSSSRLHTFGLVERGSPVKEGGNEAYSRLLKAELFGSDFGSLSPAGQGSPM SPSKNMLRFKTESSGPNSPFSPSILRQDSGFSSEASTPPKPPRKVPKTPHKVLD APSLQDDFYLNLVDWSSQNTLAVGLGTCVYLWSASNSKVTKLCDLGPNDGVCAV QWTREGSYISIGTSLGQVQIWDGTQCRRVRTMGGEQTRTGVLAWNSRILASGSR DRVILQHDLRVPNEFIGELVGHRSEVCGLKWSHDDRELASGGNDNQLLVWNQHS QQPVLKLTEHTAAVKAIAWSPHQNGLLASGGGTADRCIRFWNTTMGRQTSSVDT GSQVCNLAWSKNVNELVSTHGYSQNQIMVWKYPSMAKVATLTGHSLRVLYLAMS PDGQTIVTGAGDETLRFWNVFPSAKAPAPVKDTGLWSLGRTHIR | 213 | 1726 |
| 520 | WD40 repeat protein | MEDEAEIYDGVRAQFPLTFGKQSKPQTSLESVHSATRRGGPAGPAPAPASSSSLP STTSPSAAGGAGKSSGLPLSSSSTAWLEGLRAGMPRAGREAGIGSRGGDGEDG GRANIGPPRPPPGFSANDDGGGEDDDDDGDGVMVGPPPPPPGNLGDGDDDEEEE EANIGPPRPPVVDSDEEEEEEENRYRLPLSNEIVLKGHNKIVSALAVDPTGS RVLSGSYDYTVRMFDFQGMNSRLSSFRDFPEVGHQVRNLSWSPTADRFLCVTG SAQAKIYDRDGLTLGEFVKGDMYIRDLKNTKGHITGLTWGEWHPKTKETILTSS EDGSLRIWDVNDFKSQKQVIKPRLARPGRVPVTTCTWDREGRCIAGGIGDGSIQ IWNLKPGWGSRPDIHVEQARAQDITGLRFSSDGKILLTRSFDDSLKVWDLRLMR NPLKVFEDLPNHYAQTNIACSPDEQLFLTGTSVERESTIGLLCFFDRSKLELV SRIGISPTCSVVQCAWHPRLNQIFATSGDKSQGGTHVLYDPTLSERGALVCVAR APRKKSVDDFELRPVIHNPHALPLFRDQPSRKRQRERILKDPLKSHKPELPMNG PGHGGRVGASKGSLLTQYLLKQGGMIKETWMDEDPREAILKHADAAEKNPKFTR AYAETQPDPVFAKSDSEDEDK | 101 | 2110 |

TABLE 16

BLAST Sequence Alignment Table.

| SEQ ID | Target | Patent Identifier | BlastX top hit | Gene name | BlastX e value | BlastX identities | BlastX overlap |
|---|---|---|---|---|---|---|---|
| 1 | CDK type A | eucalyptusSpp_003910 | Q9FRN5 | PUTATIVE SERINE/THREONINE KINASE | 0 | 367 | 492 |
| 2 | CDK type A | eucalyptusSpp_019213 | O44000 | CDC2-LIKE PROTEIN KINASE TPK2 | e−160 | 217 | 290 |
| 3 | CDK type A | eucalyptusSpp_036800 | Q40789 | PROTEIN KINASE P34CDC2 | 0 | 259 | 294 |
| 4 | CDK type A | eucalyptusSpp_040260 | Q27168 | CDC2 | e−156 | 208 | 304 |
| 5 | CDK type A | eucalyptusSpp_041965 | Q43361 | CDC2PA mRNA. SPTREMBL | e−159 | 274 | 294 |
| 6 | CDK type B-1 | eucalyptusSpp_002906 | Q9FYT9 | Cyclin-dependent kinase B1-1 | e−159 | 269 | 305 |
| 7 | CDK type B-2 | eucalyptusSpp_001518 | Q9FSH4 | B2-TYPE CYCLIN DEPENDENT KINASE | 0 | 270 | 315 |
| 8 | CDK type C | eucalyptusSpp_008078 | Q9LDC1 | CRK1 protein | 0 | 415 | 558 |
| 9 | CDK type C | eucalyptusSpp_009826 | Q9LNN0 | F8L10.9 protein. SPTREMBL | 0 | 392 | 716 |
| 10 | CDK type C | eucalyptusSpp_010364 | Q8GZA7 | Putative cyclin-dependent protein kinase. | e−172 | 309 | 499 |
| 11 | CDK type C | eucalyptusSpp_011523 | Q8W2N0 | Cyclin-dependent kinase CDC2C | e−165 | 273 | 405 |
| 12 | CDK type C | eucalyptusSpp_024358 | P93320 | CDC2MSC PROTEIN | 0 | 448 | 523 |
| 13 | CDK type C | eucalyptusSpp_039125 | O80540 | F14J9.26 protein | 0 | 418 | 743 |
| 14 | CDK type D | eucalyptusSpp_005362 | O80345 | CDK-activating kinase 1AT (Cdk-activating kinase CAK1At) | e−180 | 305 | 483 |
| 15 | CDK type D | eucalyptusSpp_044857 | O80345 | CDK-activating kinase 1AT (Cdk-activating kinase CAK1At) | e−177 | 302 | 477 |
| 16 | Cyclin A | eucalyptusSpp_001743 | Q39879 | MITOTIC CYCLIN A2-TYPE | 0 | 360 | 508 |
| 17 | Cyclin A | eucalyptusSpp_012405 | Q39878 | MITOTIC CYCLIN A2-TYPE | e−179 | 278 | 470 |
| 18 | Cyclin B | eucalyptusSpp_003739 | Q9LDM4 | F2D10.10 (F5M15.6) | e−148 | 288 | 466 |
| 19 | Cyclin B | eucalyptusSpp_022338 | P93557 | Mitotic cyclin | e−168 | 310 | 476 |
| 20 | Cyclin B | eucalyptusSpp_028605 | Q40337 | B-like cyclin. SPTREMBL | e−158 | 300 | 439 |
| 21 | Cyclin B | eucalyptusSpp_041006 | Q40337 | B-like cyclin | e−158 | 300 | 439 |
| 22 | Cyclin D | eucalyptusSpp_006643 | Q9SXN7 | NtcycD3-1 protein | 1E−73 | 177 | 404 |
| 23 | Cyclin D | eucalyptusSpp_045338 | Q8LK74 | Cyclin D3.1 protein. SPTREMBL | e−101 | 190 | 332 |
| 24 | Cyclin D | eucalyptusSpp_046486 | Q9ZRX7 | CYCLIN D3.2 PROTEIN | e−126 | 196 | 373 |

TABLE 16-continued

BLAST Sequence Alignment Table.

| SEQ ID | Target | Patent Identifier | BlastX top hit | Gene name | BlastX e value | BlastX identities | BlastX overlap |
|---|---|---|---|---|---|---|---|
| 25 | Cyclin-dependent kinase regulatory subunit | eucalyptusSpp__012070 | CAB69358 | SEQUENCE 1 FROM PATENT WO9841642 | 8E−64 | 83 | 88 |
| 26 | Histone acetyltransferase | eucalyptusSpp__006617 | O80378 | 181 (Fragment) | 0 | 371 | 395 |
| 27 | Histone acetyltransferase | eucalyptusSpp__007827 | Q9FJT8 | Histone acetyltransferase HAT B | e−148 | 260 | 465 |
| 28 | Histone acetyltransferase | eucalyptusSpp__008036 | Q9FJT8 | Histone acetyltransferase HAT B. SPTREMBL | e−149 | 262 | 465 |
| 30 | Histone deacetylase | eucalyptusSpp__001596 | Q9M4T5 | Putative histone deacetylase HD2 | 7E−76 | 156 | 305 |
| 31 | Histone deacetylase | eucalyptusSpp__005870 | Q9M4T4 | Putative histone deacetylase HD2c (AT5g03740/F17C15__160) | 7E−66 | 144 | 318 |
| 32 | Histone deacetylase | eucalyptusSpp__006901 | HDAC__ARATH | Histone deacetylase (HD) | 0 | 405 | 499 |
| 33 | Histone deacetylase | eucalyptusSpp__006902 | AAM13152 | HISTONE DEACETYLASE | 0 | 427 | 499 |
| 34 | Histone deacetylase | eucalyptusSpp__007440 | Q8W508 | HISTONE DEACETYLASE | 0 | 369 | 428 |
| 35 | Histone deacetylase | eucalyptusSpp__008994 | Q8LD93 | Histone deacetylase, putative | 0 | 354 | 536 |
| 36 | Histone deacetylase | eucalyptusSpp__024580 | Q94EJ2 | At1g08460/T27G7_7 (HDA8). SPTREMBL | e−165 | 274 | 373 |
| 37 | Histone deacetylase | eucalyptusSpp__037831 | Q9FML2 | Histone deacetylase. SPTREMBL | 0 | 356 | 464 |
| 38 | MAT1 CDK-activating kinase assembly factor | eucalyptusSpp__034958 | Q8LES8 | Hypothetical protein | 4E−47 | 101 | 190 |
| 39 | Peptidylprolyl isomerase | 001209EGXC004488HT | TL40__SPIOL | Peptidylprolyl cis-trans isomerase, chloroplast precursor | 0 | 329 | 392 |
| 40 | Peptidylprolyl isomerase | 010310EGXD012820HT | Q9FJL3 | PEPTIDYLPROLYL ISOMERASE | 0 | 453 | 579 |
| 41 | Peptidylprolyl isomerase | 010310EGXD013036HT | O82646 | HYPOTHETICAL 57.1 KDA PROTEIN (EC 5.2.1.8) | 0 | 302 | 521 |
| 42 | Peptidylprolyl isomerase | 010316EGXF999037HT | BAB39983 | PUTATIVE PEPTIDYLPROLYL CIS-TRANS ISOMERASE, CHLOROPLAST | e−115 | 146 | 172 |
| 43 | Peptidylprolyl isomerase | 010324EGXF002118HT | AAK32894 | AT5G13120/T19L5__80 | e−122 | 179 | 264 |
| 44 | Peptidylprolyl isomerase | 011019EGKA001923HT | AAM14253 | HYPOTHETICAL 20.3 KDA PROTEIN | e−108 | 146 | 188 |
| 45 | Peptidylprolyl isomerase | eucalyptusSpp__000966 | Q8L5T1 | Peptidylprolyl isomerase (Cyclophilin) (EC 5.2.1.8) | 1E−91 | 155 | 170 |

TABLE 16-continued

BLAST Sequence Alignment Table.

| SEQ ID | Target | Patent Identifier | BlastX top hit | Gene name | BlastX e value | BlastX identities | BlastX overlap |
|---|---|---|---|---|---|---|---|
| 46 | Peptidylprolyl isomerase | eucalyptusSpp__001037 | Q8VX73 | CYCLOPHILIN (EC 5.2.1.8) | e−120 | 155 | 169 |
| 47 | Peptidylprolyl isomerase | eucalyptusSpp__004603 | AAM14253 | HYPOTHETICAL 20.3 KDA PROTEIN | e−108 | 146 | 188 |
| 48 | Peptidylprolyl isomerase | eucalyptusSpp__005465 | Q9SP02 | Cyclophilin ROC7 (EC 5.2.1.8) (AT5g58710/mzn1_160) (Pepti . . . | 2E−93 | 172 | 204 |
| 49 | Peptidylprolyl isomerase | eucalyptusSpp__006571 | O49605 | EC 5.2.1.8 (Cyclophilin-like protein) | 9E−98 | 169 | 224 |
| 50 | Peptidylprolyl isomerase | eucalyptusSpp__006786 | Q93VG0 | Cyclophilin (EC 5.2.1.8) (Peptidylprolyl cis-trans | 5E−82 | 142 | 164 |
| 51 | Peptidylprolyl isomerase | eucalyptusSpp__007057 | Q38901 | Cytosolic cyclophilin (EC 5.2.1.8) (Peptidylprolyl | 3E−84 | 144 | 172 |
| 52 | Peptidylprolyl isomerase | eucalyptusSpp__008670 | Q9FJL3 | PEPTIDYLPROLYL ISOMERASE | 0 | 423 | 596 |
| 53 | Peptidylprolyl isomerase | eucalyptusSpp__009137 | Q9C566 | Cyclophilin-40 (EC 5.2.1.8) (Expressed protein) | e−168 | 285 | 361 |
| 54 | Peptidylprolyl isomerase | eucalyptusSpp__010285 | Q9LY75 | Cyclophylin-like protein (EC 5.2.1.8) (Peptidylprolyl | e−160 | 345 | 658 |
| 55 | Peptidylprolyl isomerase | eucalyptusSpp__010600 | Q93YQ8 | HYPOTHETICAL 50.1 KDA PROTEIN (FRAGMENT) | 0 | 346 | 475 |
| 56 | Peptidylprolyl isomerase | eucalyptusSpp__011551 | Q9ZVG4 | T2P11.13 PROTEIN | e−115 | 154 | 192 |
| 57 | Peptidylprolyl isomerase | eucalyptusSpp__020743 | Q8VXA5 | PUTATIVE CYCLOSPORIN A-BINDING PROTEIN | e−125 | 161 | 172 |
| 58 | Peptidylprolyl isomerase | eucalyptusSpp__023739 | FK21_NEUCR | FK506-binding protein precursor (FKBP-21) | 3E−49 | 74 | 112 |
| 60 | Peptidylprolyl isomerase | eucalyptusSpp__031985 | Q8L8W5 | Cyclophilin-like protein (EC 5.2.1.8) (Peptidylprolyl | 1E−82 | 155 | 229 |
| 61 | Peptidylprolyl isomerase | eucalyptusSpp__032025 | Q9LPC7 | F22M8.7 protein (EC 5.2.1.8) (Peptidylprolyl cis-trans | 1E−45 | 99 | 160 |
| 62 | Peptidylprolyl isomerase | eucalyptusSpp__032173 | Q8L8W5 | Cyclophilin-like protein (EC 5.2.1.8) (Peptidylprolyl | 4E−83 | 156 | 229 |
| 64 | Retinoblastoma related protein | eucalyptusSpp__009143 | Q9SLZ4 | Retinoblastoma-related protein | 0 | 704 | 1008 |
| 65 | WD40 repeat protein | eucalyptusSpp__000349 | AAK49947 | TGF-BETA RECEPTOR-INTERACTING PROTEIN 1 | 0 | 291 | 326 |

TABLE 16-continued

BLAST Sequence Alignment Table.

| SEQ ID | Target | Patent Identifier | BlastX top hit | Gene name | BlastX e value | BlastX identities | BlastX overlap |
|---|---|---|---|---|---|---|---|
| 66 | WD40 repeat protein | eucalyptusSpp__000575 | Q9LW17 | WD-40 repeat protein-like (Expressed protein) | e−168 | 282 | 341 |
| 67 | WD40 repeat protein | eucalyptusSpp__000804 | GBLP_SOYBN | Guanine nucleotide-binding protein beta subunit-like | 0 | 291 | 326 |
| 68 | WD40 repeat protein | eucalyptusSpp__000805 | GBLP_MEDSA | Guanine nucleotide-binding protein beta | e−171 | 291 | 327 |
| 69 | WD40 repeat protein | eucalyptusSpp__000806 | GBLP_MEDSA | Guanine nucleotide-binding protein beta subunit-like | e−171 | 291 | 327 |
| 70 | WD40 repeat protein | eucalyptusSPP__002248 | AAL86002 | HYPOTHETICAL 43.8 KDA PROTEIN | 0 | 261 | 388 |
| 71 | WD40 repeat protein | eucalyptusSPP__003203 | Q9SY00 | Putative WD-repeat protein (AT4G02730/T5J8_2) | e−144 | 236 | 317 |
| 72 | WD40 repeat protein | eucalyptusSPP__003209 | AAM14986 | HYPOTHETICAL 32.6 KDA PROTEIN | e−160 | 259 | 302 |
| 73 | WD40 repeat protein | eucalyptusSPP__004429 | Q9SZQ5 | HYPOTHETICAL 34.3 KDA PROTEIN | 0 | 260 | 322 |
| 74 | WD40 repeat protein | eucalyptusSPP__004607 | AAC27402 | EXPRESSED PROTEIN | 0 | 253 | 356 |
| 75 | WD40 repeat protein | eucalyptusSPP__004682 | AAK00964 | HYPOTHETICAL 35.3 KDA PROTEIN | 0 | 264 | 313 |
| 76 | WD40 repeat protein | eucalyptusSPP__005786 | Q944S2 | At2g47790/F17A22.18 (Expressed protein). SPTREMBL | e−155 | 264 | 396 |
| 77 | WD40 repeat protein | eucalyptusSPP__005887 | Q94AB4 | AT3g13340/MDC11_13 | 0 | 332 | 446 |
| 78 | WD40 repeat protein | eucalyptusSPP__005981 | Q8L4X6 | WD-repeat protein GhTTG2. SPTREMBL | 0 | 315 | 348 |
| 79 | WD40 repeat protein | eucalyptusSPP__006766 | Q8L4M1 | Putative WD-40 repeat protein | e−137 | 234 | 369 |
| 80 | WD40 repeat protein | eucalyptusSPP__006769 | Q9LJC6 | RETINOBLASTOMA-BINDING PROTEIN-LIKE | 0 | 372 | 566 |
| 81 | WD40 repeat protein | eucalyptusSPP__006907 | Q94C94 | Hypothetical protein. | 0 | 446 | 812 |
| 82 | WD40 repeat protein | eucalyptusSPP__007518 | Q93ZN5 | AT4G00090/F6N15_8 | 0 | 311 | 436 |
| 83 | WD40 repeat protein | eucalyptusSpp__007717 | O82266 | At2g47990 protein (Hypothetical 58.9 kDa protein) | e−180 | 327 | 528 |
| 84 | WD40 repeat protein | eucalyptusSpp__007718 | Q8RWD8 | Hypothetical protein. SPTREMBL | e−173 | 278 | 350 |
| 85 | WD40 repeat protein | eucalyptusSpp__007741 | Q8LA40 | Putative WD-40 repeat protein, MSI2 | e−158 | 269 | 409 |
| 86 | WD40 repeat protein | eucalyptusSpp__007884 | Q9FHY2 | Similarity to unknown protein | e−149 | 316 | 765 |

TABLE 16-continued

BLAST Sequence Alignment Table.

| SEQ ID | Target | Patent Identifier | BlastX top hit | Gene name | BlastX e value | BlastX identities | BlastX overlap |
|---|---|---|---|---|---|---|---|
| 87 | WD40 repeat protein | eucalyptusSpp_008258 | Q9LHN3 | EMB\|CAB63739.1 (AT3G18860/MCB22_3) | 0 | 524 | 758 |
| 88 | WD40 repeat protein | eucalyptusSpp_008465 | Q9FLS2 | WD-repeat protein-like | 0 | 366 | 460 |
| 89 | WD40 repeat protein | eucalyptusSpp_008616 | Q9LYK6 | Hypothetical protein | e-148 | 252 | 321 |
| 90 | WD40 repeat protein | eucalyptusSpp_008690 | Q9SW94 | G PROTEIN BETA SUBUNIT | 0 | 326 | 376 |
| 91 | WD40 repeat protein | eucalyptusSpp_008708 | Q8L862 | Hypothetical protein | e-167 | 297 | 487 |
| 92 | WD40 repeat protein | eucalyptusSpp_008850 | O22725 | F11P17.7 protein. SPTREMBL | 0 | 402 | 853 |
| 93 | WD40 repeat protein | eucalyptusSpp_009072 | Q9SAJ0 | F23A5.2 (form 2) (mRNA export protein, putative) | e-176 | 288 | 350 |
| 94 | WD40 repeat protein | eucalyptusSpp_009465 | Q9FLX9 | NOTCHLESS PROTEIN HOMOLOG | 0 | 384 | 475 |
| 95 | WD40 repeat protein | eucalyptusSpp_009472 | Q9SZA4 | WD-REPEAT PROTEIN-LIKE PROTEIN | 0 | 374 | 457 |
| 96 | WD40 repeat protein | eucalyptusSpp_009550 | Q9FKT5 | Gb\|AAF54217.1 (Hypothetical protein) | e-167 | 275 | 313 |
| 97 | WD40 repeat protein | eucalyptusSpp_010284 | O22466 | WD-40 repeat protein MSI1 | 0 | 397 | 423 |
| 98 | WD40 repeat protein | eucalyptusSpp_010595 | Q94C94 | Hypothetical protein | 0 | 419 | 789 |
| 99 | WD40 repeat protein | eucalyptusSpp_010657 | Q94AH2 | HYPOTHETICAL 33.1 KDA PROTEIN | 0 | 243 | 298 |
| 100 | WD40 repeat protein | eucalyptusSpp_012636 | Q8L611 | Hypothetical protein | 0 | 756 | 1133 |
| 101 | WD40 repeat protein | eucalyptusSpp_012748 | AAD10151 | PUTATIVE WD-40 REPEAT PROTEIN, MSI4 | 0 | 375 | 469 |
| 102 | WD40 repeat protein | eucalyptusSpp_012879 | Q8VZY6 | FERTILIZATION-INDEPENDENT ENDOSPERM PROTEIN | 0 | 291 | 377 |
| 103 | WD40 repeat protein | eucalyptusSpp_015515 | Q8LPI5 | Putative WD-repeat protein. SPTREMBL | 0 | 360 | 493 |
| 104 | WD40 repeat protein | eucalyptusSpp_015724 | O22607 | WD-40 repeat protein MSI4 | 0 | 395 | 522 |
| 105 | WD40 repeat protein | eucalyptusSpp_016167 | Q93YS7 | Putative WD-repeat membrane protein | 0 | 663 | 917 |
| 106 | WD40 repeat protein | eucalyptusSpp_016633 | Q9SUY6 | HYPOTHETICAL 43.8 KDA PROTEIN | e-174 | 240 | 384 |
| 107 | WD40 repeat protein | eucalyptusSpp_017485 | Q8RXC4 | Hypothetical 144.7 kDa protein | 0 | 650 | 1348 |
| 108 | WD40 repeat protein | eucalyptusSpp_018007 | O94289 | WD repeat-containing protein | e-129 | 302 | 794 |
| 109 | WD40 repeat protein | eucalyptusSpp_020775 | Q8W403 | Sec13p | e-150 | 242 | 304 |
| 110 | WD40 repeat protein | eucalyptusSpp_023132 | AAK52092 | WD-40 REPEAT PROTEIN | 0 | 458 | 515 |
| 111 | WD40 repeat protein | eucalyptusSpp_023569 | Q9XIJ3 | T10O24.21. SPTREMBL | 0 | 404 | 576 |

TABLE 16-continued

BLAST Sequence Alignment Table.

| SEQ ID | Target | Patent Identifier | BlastX top hit | Gene name | BlastX e value | BlastX identities | BlastX overlap |
|---|---|---|---|---|---|---|---|
| 112 | WD40 repeat protein | eucalyptusSpp__023611 | Q8L4J2 | Cleavage stimulation factor 50K chain (Cleavage stimulation | e−174 | 301 | 438 |
| 113 | WD40 repeat protein | eucalyptusSpp__024934 | Q94AB4 | AT3g13340/MDC11_13. WD-repeat protein-like SPTREMBL | 0 | 343 | 444 |
| 114 | WD40 repeat protein | eucalyptusSpp__025546 | O22212 | Hypothetical 61.8 kDa Trp-Asp repeats containing protein | 0 | 352 | 566 |
| 115 | WD40 repeat protein | eucalyptusSpp__030134 | Q9LVF2 | Genomic DNA, chromosome 3, P1 clone: MIL23 | 0 | 677 | 946 |
| 116 | WD40 repeat protein | eucalyptusSpp__031787 | AAL91206 | WD REPEAT PROTEIN-LIKE | 0 | 264 | 329 |
| 117 | WD40 repeat protein | eucalyptusSpp__034435 | Q9SAJ0 | F23A5.2(form 2) (mRNA export protein, putative). SPTREMBL | e−178 | 290 | 349 |
| 118 | WD40 repeat protein | eucalyptusSpp__034452 | Q94BR4 | Hypothetical protein (Putative pre-mRNA splicing factor | 0 | 381 | 525 |
| 119 | WD40 repeat protein | eucalyptusSpp__035789 | P93563 | Guanine nucleotide-binding protein beta subunit | 3E−88 | 171 | 356 |
| 120 | WD40 repeat protein | eucalyptusSpp__035804 | Q9FNN2 | WD-repeat protein-like. SPTREMBL | 0 | 356 | 589 |
| 121 | WD40 repeat protein | eucalyptusSpp__043057 | Q9LV35 | WD40-repeat protein. SPTREMBL | 0 | 472 | 610 |
| 122 | WD40 repeat protein | eucalyptusSpp__046741 | Q93VK1 | AT4g28450/F20o9_130 | 0 | 363 | 452 |
| 123 | WD40 repeat protein | eucalyptusSpp__047161 | Q9ZUN8 | Putative WD-40 repeat protein | 0 | 350 | 473 |
| 124 | CDK type A | pinusRadiata__001766 | Q9M3W7 | PUTATIVE CDC2-RELATED PROTEIN KINASE CRK2. 459 e−128 | e−128 | 237 | 436 |
| 125 | CDK type A | pinusRadiata__002927 | Q9FRN5 | PUTATIVE SERINE/THREONINE KINASE | 0 | 349 | 470 |
| 126 | CDK type B-1 | 990309PRCA009171HT | Q9FYT8 | Cyclin-dependent kinase B1-2 | e−145 | 244 | 303 |
| 127 | CDK type B-1 | pinusRadiata__013714 | Q9FYT8 | CYCLIN-DEPENDENT KINASE B1-2 | e−174 | 222 | 304 |
| 128 | CDK type B-1 | pinusRadiata__016332 | Q9FYT8 | CYCLIN-DEPENDENT KINASE B1-2 | e−178 | 228 | 304 |
| 129 | CDK type B-1 | pinusRadiata__021677 | Q9FYT8 | CYCLIN-DEPENDENT KINASE B1-2 | e−176 | 229 | 304 |

TABLE 16-continued

BLAST Sequence Alignment Table.

| SEQ ID | Target | Patent Identifier | BlastX top hit | Gene name | BlastX e value | BlastX identities | BlastX overlap |
|---|---|---|---|---|---|---|---|
| 130 | CDK type B-1 | pinusRadiata__027562 | Q9FYT8 | Cyclin-dependent kinase B1-2 | e−118 | 211 | 304 |
| 131 | CDK type C | pinusRadiata__001504 | Q9LNN0 | F8L10.9 protein | 0 | 434 | 790 |
| 132 | CDK type C | pinusRadiata__015211 | Q9LNN0 | F8L10.9 protein | 0 | 371 | 746 |
| 133 | CDK type C | pinusRadiata__020421 | P93320 | Cdc2MsC protein | 0 | 318 | 432 |
| 134 | CDK type D | pinusRadiata__003187 | O80345 | CDK-ACTIVATING KINASE 1AT (CDK-ACTIVATING KINASE CAK1AT) | e−137 | 226 | 485 |
| 135 | CDK type D | pinusRadiata__015661 | Q947K6 | CDK-ACTIVATING KINASE. | 0 | 266 | 407 |
| 136 | Cyclin A | pinusRadiata__013874 | Q96226 | Cyclin | e−108 | 223 | 474 |
| 137 | Cyclin A | pinusRadiata__014615 | CAC27333 | PUTATIVE A-LIKE CYCLIN (FRAGMENT) | 0 | 332 | 390 |
| 138 | Cyclin B | pinusRadiata__004578 | O65064 | Probable G2/mitotic-specific cyclin (Fragment) | 9E−87 | 162 | 217 |
| 139 | Cyclin B | pinusRadiata__023387 | O04389 | B-like cyclin | 2E−98 | 220 | 466 |
| 140 | Cyclin D | pinusRadiata__006970 | P93103 | CYCLIN-D LIKE PROTEIN | 1E−75 | 135 | 293 |
| 141 | Cyclin D | pinusRadiata__010322 | CAC17049 | SEQUENCE 33 FROM PATENT WO0065040 | e−131 | 171 | 254 |
| 142 | Cyclin D | pinusRadiata__022721 | P93103 | CYCLIN-D LIKE PROTEIN | 1E−76 | 137 | 289 |
| 143 | Cyclin D | pinusRadiata__023407 | Q9SMD5 | CYCD3,2 PROTEIN | 8E−90 | 139 | 278 |
| 144 | Cyclin-dependent kinase regulatory subunit | pinusRadiata__001945 | Q947Y1 | PUTATIVE CYCLIN-DEPENDENT KINASE REGULATORY SUBUNIT | 5E−55 | 74 | 86 |
| 145 | Cyclin-dependent kinase regulatory subunit | pinusRadiata__008233 | CAB69358 | SEQUENCE 1 FROM PATENT WO9841642 | 4E−49 | 65 | 86 |
| 146 | Cyclin-dependent kinase regulatory subunit | pinusRadiata__008234 | CAB69358 | SEQUENCE 1 FROM PATENT WO9841642 | 4E−49 | 65 | 86 |
| 147 | Cyclin-dependent kinase regulatory subunit | pinusRadiata__022054 | CAB69358 | SEQUENCE 1 FROM PATENT WO9841642 | 8E−55 | 70 | 82 |
| 148 | Histone acetyltransferase | pinusRadiata__012137 | Q9FK40 | Histone acetyltransferase (AT5g50320/MXI22_3) | 0 | 496 | 555 |
| 149 | Histone acetyltransferase | pinusRadiata__012582 | O80378 | 181 (Fragment) SPTREMBL | 0 | 354 | 402 |
| 150 | Histone acetyltransferase | pinusRadiata__015285 | O80378 | 181 (Fragment) | 0 | 342 | 401 |
| 151 | Histone acetyltransferase | pinusRadiata__017229 | Q9LNC4 | F9P14.9 protein | e−118 | 268 | 585 |

TABLE 16-continued

BLAST Sequence Alignment Table.

| SEQ ID | Target | Patent Identifier | BlastX top hit | Gene name | BlastX e value | BlastX identities | BlastX overlap |
|---|---|---|---|---|---|---|---|
| 152 | Histone acetyltransferase | pinusRadiata__020724 | Q9AR19 | Histone acetyltransferase GCN5 (Expressed protein) | e−177 | 355 | 639 |
| 153 | Histone deacetylase | pinusRadiata__004555 | AAM13152 | HISTONE DEACETYLASE | 0 | 331 | 488 |
| 154 | Histone deacetylase | pinusRadiata__004556 | AAM13152 | HISTONE DEACETYLASE | 0 | 331 | 488 |
| 155 | Histone deacetylase | pinusRadiata__005729 | Q9M4U5 | Histone deacetylase 2 isoform b | 9E−62 | 154 | 348 |
| 156 | Histone deacetylase | pinusRadiata__007395 | AAM13152 | HISTONE DEACETYLASE | 0 | 335 | 426 |
| 157 | Histone deacetylase | pinusRadiata__009503 | Q8W508 | Histone deacetylase | 0 | 365 | 427 |
| 158 | Histone deacetylase | pinusRadiata__011283 | AAM19887 | AT1G08460/T27G7__7 | 0 | 255 | 366 |
| 159 | Histone deacetylase | pinusRadiata__012322 | Q9FML2 | HISTONE DEACETYLASE (PUTATIVE HISTONE DEACETYLASE) | 0 | 327 | 435 |
| 161 | Histone deacetylase | pinusRadiata__023236 | Q8RX28 | Putative histone deacetylase | e−144 | 238 | 390 |
| 162 | Peptidylprolyl isomerase | pinusRadiata__000171 | Q9FJL3 | PEPTIDYLPROLYL ISOMERASE | 0 | 364 | 549 |
| 163 | Peptidylprolyl isomerase | pinusRadiata__000172 | Q38949 | FK506 BINDING PROTEIN FKBP62 (ROF1) | 0 | 365 | 552 |
| 164 | Peptidylprolyl isomerase | pinusRadiata__001480 | Q8VXA5 | PUTATIVE CYCLOSPORIN A-BINDING PROTEIN | e−125 | 161 | 172 |
| 168 | Peptidylprolyl isomerase | pinusRadiata__001692 | FKB7__WHEAT | 70 kDa peptidylprolyl isomerase (EC 5.2.1.8) | 0 | 418 | 553 |
| 169 | Peptidylprolyl isomerase | pinusRadiata__005313 | AAB64339 | FKBP-TYPE PEPTIDYLPROLYL CIS-TRANS ISOMERASE | 1E−97 | 135 | 175 |
| 170 | Peptidylprolyl isomerase | pinusRadiata__006362 | BAB39983 | PUTATIVE PEPTIDYLPROLYL CIS-TRANS ISOMERASE, CHLOROPLA . . . 290 3e−77 | 3E−77 | 129 | 168 |
| 171 | Peptidylprolyl isomerase | pinusRadiata__006493 | Q9C835 | Hypothetical 26.4 kDa protein (EC 5.2.1.8) (Peptidylprol . . . | 2E−62 | 128 | 235 |
| 172 | Peptidylprolyl isomerase | pinusRadiata__006983 | AAK96784 | CYCLOPHILIN | e−103 | 151 | 204 |
| 174 | Peptidylprolyl isomerase | pinusRadiata__007665 | Q9LDC0 | FKBP-like protein (Genomic DNA, chromosome 3, P1 clone: | e−138 | 239 | 378 |
| 175 | Peptidylprolyl isomerase | pinusRadiata__012196 | Q93VG0 | Cyclophilin (EC 5.2.1.8) (Peptidylprolyl cis-trans | 4E−74 | 132 | 160 |
| 176 | Peptidylprolyl isomerase | pinusRadiata__013382 | Q9C588 | HYPOTHETICAL 60.2 KDA PROTEIN | 0 | 288 | 581 |

TABLE 16-continued

BLAST Sequence Alignment Table.

| SEQ ID | Target | Patent Identifier | BlastX top hit | Gene name | BlastX e value | BlastX identities | BlastX overlap |
|---|---|---|---|---|---|---|---|
| 177 | Peptidylprolyl isomerase | pinusRadiata_016461 | O04287 | IMMUNOPHILIN | 9E-66 | 88 | 109 |
| 178 | Peptidylprolyl isomerase | pinusRadiata_017611 | Q9C566 | Cyclophilin-40 (EC 5.2.1.8) (Expressed protein) | e-163 | 276 | 360 |
| 179 | Peptidylprolyl isomerase | pinusRadiata_019776 | AAM14253 | HYPOTHETICAL 20.3 KDA PROTEIN | e-110 | 146 | 190 |
| 180 | Peptidylprolyl isomerase | pinusRadiata_020659 | AAO63961 | Hypothetical protein SPTREMBL | 7E-85 | 159 | 227 |
| 181 | Peptidylprolyl isomerase | pinusRadiata_022559 | AAK43974 | PUTATIVE PEPTIDYLPROLYL CIS-TRANS ISOMERASE | 2E-73 | 113 | 153 |
| 182 | Peptidylprolyl isomerase | pinusRadiata_024188 | Q9P3X9 | PEPTIDYLPROLYL CIS-TRANS ISOMERASE (EC 5.2.1.8) | e-122 | 210 | 379 |
| 183 | Peptidylprolyl isomerase | pinusRadiata_027973 | Q9SR70 | T22K18.11 protein (AT3g10060/T22K18_11) | 3E-69 | 125 | 171 |
| 184 | WD40 repeat protein | pinusRadiata_001353 | Q9FNN2 | WD-repeat protein-likeSPTREMBL | 0 | 317 | 590 |
| 185 | WD40 repeat protein | pinusRadiata_001978 | PRL1_ARATH | PP1/PP2A phosphatases pleiotropic regulator PRL1 | 0 | 341 | 502 |
| 186 | WD40 repeat protein | pinusRadiata_002810 | AAK49947 | TGF-BETA RECEPTOR-INTERACTING PROTEIN 1 | 0 | 273 | 326 |
| 187 | WD40 repeat protein | pinusRadiata_002811 | AAK49947 | TGF-BETA RECEPTOR-INTERACTING PROTEIN 1 | 0 | 273 | 326 |
| 188 | WD40 repeat protein | pinusRadiata_002812 | AAM15129 | HYPOTHETICAL 58.9 KDA PROTEIN | e-127 | 225 | 521 |
| 189 | WD40 repeat protein | pinusRadiata_003514 | Q9FJ94 | Similarity to myosin heavy chain kinaseSPTREMBL | e-137 | 242 | 445 |
| 190 | WD40 repeat protein | pinusRadiata_004104 | GBB_ORYSA | Guanine nucleotide-binding protein beta subunit | 0 | 294 | 378 |
| 191 | WD40 repeat protein | pinusRadiata_005595 | Q9FTT9 | PUTATIVE DKFZP564O0463 PROTEIN | 0 | 320 | 459 |
| 192 | WD40 repeat protein | pinusRadiata_005754 | Q94JT6 | At1g78070/F28K19_28SPTREMBL | e-168 | 294 | 451 |
| 193 | WD40 repeat protein | pinusRadiata_006463 | GBLP_MEDSA | Guanine nucleotide-binding protein beta subunit-like . . . 538 e-152 | e-152 | 261 | 324 |
| 194 | WD40 repeat protein | pinusRadiata_006665 | AAM20553 | HYPOTHETICAL 119.9 KDA PROTEIN. 1229 0.0 | 0 | 655 | 1169 |
| 195 | WD40 repeat protein | pinusRadiata_006750 | AAM13119 | HYPOTHETICAL 35.4 KDA PROTEIN. 560 e-158 | e-158 | 264 | 312 |

TABLE 16-continued

BLAST Sequence Alignment Table.

| SEQ ID | Target | Patent Identifier | BlastX top hit | Gene name | BlastX e value | BlastX identities | BlastX overlap |
|---|---|---|---|---|---|---|---|
| 196 | WD40 repeat protein | pinusRadiata__007030 | Q9LJN8 | MITOTIC CHECKPOINT PROTEIN. 595 e−169 | e−169 | 284 | 335 |
| 197 | WD40 repeat protein | pinusRadiata__007854 | Q8H919 | Putative WD domain containing protein | 0 | 429 | 644 |
| 198 | WD40 repeat protein | pinusRadiata__007917 | AAD10151 | PUTATIVE WD-40 REPEAT PROTEIN, MSI4 | 0 | 353 | 462 |
| 199 | WD40 repeat protein | pinusRadiata__007989 | Q9LRZ0 | Genomic DNA, chromosome 3, TAC clone: K20I9 | 0 | 480 | 687 |
| 200 | WD40 repeat protein | pinusRadiata__008506 | MSI1_LYCES | WD-40 repeat protein MSI1 | 0 | 364 | 420 |
| 201 | WD40 repeat protein | pinusRadiata__008692 | Q8W403 | Sec13p | e−134 | 218 | 301 |
| 202 | WD40 repeat protein | pinusRadiata__008693 | Q8W403 | Sec13p | e−137 | 222 | 301 |
| 203 | WD40 repeat protein | pinusRadiata__009170 | Q9M0V4 | U3 snoRNP-associated-like protein. SPTREMBL | e−127 | 244 | 524 |
| 204 | WD40 repeat protein | pinusRadiata__009408 | Q9SAJ0 | F23A5.2(FORM 2). 602 e−171 | e−171 | 282 | 350 |
| 205 | WD40 repeat protein | pinusRadiata__009522 | Q8RXQ4 | Hypothetical 43.8 kDa protein | e−129 | 231 | 395 |
| 206 | WD40 repeat protein | pinusRadiata__009734 | AAO27452 | Peroxisomal targeting signal type 2 receptor. SPTREMBL | e−142 | 227 | 317 |
| 207 | WD40 repeat protein | pinusRadiata__009815 | AAM20433 | CELL CYCLE SWITCH PROTEIN | 0 | 326 | 500 |
| 208 | WD40 repeat protein | pinusRadiata__010670 | AAN72058 | Expressed protein | e−157 | 264 | 345 |
| 209 | WD40 repeat protein | pinusRadiata__011297 | AAM13100 | WD REPEAT PROTEIN ATAN11 | e−157 | 262 | 337 |
| 210 | WD40 repeat protein | pinusRadiata__013098 | AAM13153 | HYPOTHETICAL 39.1 KDA PROTEIN. 487 e−136 | e−136 | 229 | 352 |
| 211 | WD40 repeat protein | pinusRadiata__013172 | Q8H0T9 | Hypothetical protein | 0 | 437 | 860 |
| 212 | WD40 repeat protein | pinusRadiata__013589 | AAK52092 | WD-40 REPEAT PROTEIN | 0 | 448 | 512 |
| 213 | WD40 repeat protein | pinusRadiata__013608 | AAC27402 | EXPRESSED PROTEIN | e−141 | 202 | 358 |
| 214 | WD40 repeat protein | pinusRadiata__014299 | Q9XED5 | Cell cycle switch proteinSPTREMBL | 0 | 335 | 488 |
| 215 | WD40 repeat protein | pinusRadiata__014498 | Q9FH64 | WD REPEAT PROTEIN-LIKE | e−152 | 206 | 329 |
| 216 | WD40 repeat protein | pinusRadiata__014548 | Q93ZS6 | HYPOTHETICAL 82.2 KDA PROTEIN | 0 | 505 | 763 |
| 217 | WD40 repeat protein | pinusRadiata__014610 | Q9M298 | Hypothetical 104.7 kDa protein | 0 | 450 | 922 |
| 218 | WD40 repeat protein | pinusRadiata__016090 | Q9SIY9 | Putative WD-40 repeat proteinSPTREMBL | 0 | 442 | 802 |
| 219 | WD40 repeat protein | pinusRadiata__016722 | O22826 | Putative splicing factorSPTREMBL | e−159 | 257 | 310 |
| 220 | WD40 repeat protein | pinusRadiata__016785 | AAG60193 | PUTATIVE WD40 PROTEIN | 0 | 344 | 464 |

TABLE 16-continued

BLAST Sequence Alignment Table.

| SEQ ID | Target | Patent Identifier | BlastX top hit | Gene name | BlastX e value | BlastX identities | BlastX overlap |
|---|---|---|---|---|---|---|---|
| 221 | WD40 repeat protein | pinusRadiata_017094 | Q9LV35 | WD40-REPEAT PROTEIN | 0 | 406 | 604 |
| 222 | WD40 repeat protein | pinusRadiata_017527 | Q9AYE4 | Hypothetical 35.3 kDa protein | e−154 | 254 | 314 |
| 223 | WD40 repeat protein | pinusRadiata_017591 | O80706 | F8K4.21 protein | 0 | 905 | 1218 |
| 224 | WD40 repeat protein | pinusRadiata_017769 | Q9XIJ3 | T10O24.21 | 0 | 446 | 607 |
| 225 | WD40 repeat protein | pinusRadiata_018047 | Q8VZY6 | FERTILIZATION-INDEPENDENT ENDOSPERM PROTEIN | 0 | 285 | 373 |
| 226 | WD40 repeat protein | pinusRadiata_018414 | Q947M8 | COPI | 0 | 455 | 638 |
| 227 | WD40 repeat protein | pinusRadiata_018986 | Q9LFE2 | WD40-repeat protein | 0 | 518 | 886 |
| 228 | WD40 repeat protein | pinusRadiata_019479 | Q9SZA4 | WD-repeat protein-like protein | e−156 | 276 | 454 |
| 229 | WD40 repeat protein | pinusRadiata_020144 | Q8W514 | MSI TYPE NUCLEOSOME/CHROMATIN ASSEMBLY FACTOR C | 0 | 288 | 413 |
| 230 | WD40 repeat protein | pinusRadiata_022480 | Q8W514 | MSI type nucleosome/chromatin assembly factor C | e−167 | 287 | 426 |
| 231 | WD40 repeat protein | pinusRadiata_023079 | Q8W514 | MSI type nucleosome/chromatin assembly factor C. SPTREMBL | e−169 | 283 | 397 |
| 232 | WD40 repeat protein | pinusRadiata_026739 | Q93YS7 | Putative WD-repeat membrane protein. SPTREMBL | 0 | 591 | 918 |
| 233 | WD40 repeat protein | pinusRadiata_026951 | Q93VS5 | AT4g18900/F13C5_70 (Hypothetica 1 protein) | e−163 | 290 | 503 |
| 234 | WEE1-like protein | pinusRadiata_026529 | Q9SRY9 | F22D16.3 PROTEIN | e−122 | 209 | 451 |
| 235 | WD40 repeat protein | eucalyptusSpp_006366 | Q8LF96 | PRL1 protein | 0 | 374 | 492 |
| 236 | WD40 repeat protein | eucalyptusSpp_017378 | O22607 | WD-40 repeat protein MSI4 | 0 | 371 | 453 |
| 237 | WD40 repeat protein | pinusRadiata_000888 | O22466 | WD-40 repeat protein MSI1 | 0 | 364 | 420 |
| 238 | Cyclin-dependant kinase inhibitor | pinusRadiata_014166 | Q9FKB5 | GENOMIC DNA, CHROMOSOME 5, TAC CLONE: K24G6 (CYCLIN-DEPENDENT | 5E−42 | 114 | 304 |
| 239 | CDK type D | pinusRadiata_003189 | Q9M5G4 | CDK-activating kinase | 8E−21 | 56 | 100 |
| 240 | Histone acetyltransferase | pinusRadiata_009356 | Q9FJT8 | Histone acetyltransferase HAT B | 7E−85 | 187 | 510 |
| 241 | Histone deacetylase | pinusRadiata_000065 | Q9LPW6 | F13K23.8 protein. | 5E−18 | 71 | 209 |
| 242 | Histone deacetylase | pinusRadiata_014197 | Q8GXJ1 | Putative histone deacetylase | e−170 | 308 | 519 |
| 243 | Peptidylprolyl isomerase | pinusRadiata_009081 | Q9ZRQ9 | Cyclophilin (EC 5.2.1.8) (Peptidylprolyl cis-trans | e−106 | 185 | 190 |

TABLE 16-continued

BLAST Sequence Alignment Table.

| SEQ ID | Target | Patent Identifier | BlastX top hit | Gene name | BlastX e value | BlastX identities | BlastX overlap |
|---|---|---|---|---|---|---|---|
| 244 | Peptidylprolyl isomerase | pinusRadiata__013417 | Q8H4T0 | Putative Peptidylprolylcis-trans isomerase protein | e-140 | 235 | 345 |
| 245 | WD40 repeat protein | pinusRadiata__005755 | Q9SKW4 | F5J5.6. | e-143 | 144 | 319 |
| 246 | WD40 repeat protein | pinusRadiata__006670 | Q9LDG7 | WD-40 repeat protein-like (MJK13.13 protein) | e-163 | 393 | 960 |
| 247 | WD40 repeat protein | pinusRadiata__007027 | Q8GWR1 | Hypothetical protein. | e-157 | 276 | 470 |
| 248 | WD40 repeat protein | pinusRadiata__007276 | Q9LF27 | Hypothetical 47.3 kDa protein | e-138 | 235 | 428 |
| 249 | WD40 repeat protein | pinusRadiata__007390 | Q94AH4 | PUTATIVE RING ZINC FINGER PROTEIN. 91 3e-17 | 3E-17 | 53 | 158 |
| 250 | WD40 repeat protein | pinusRadiata__012648 | O22212 | Hypothetical 61.8 kDa Trp-Asp repeats containing protein | 0 | 324 | 561 |
| 251 | WD40 repeat protein | pinusRadiata__013171 | Q8H0T9 | Hypothetical. protein. | 0 | 437 | 860 |
| 252 | Cyclin B | eucalyptusSpp__045414 | Q9LDM4 | F2D10.10 (F5M15.6) | e-142 | 255 | 423 |
| 253 | Cyclin-dependant kinase inhibitor | eucalyptusSpp__044328 | Q9FKB5 | GENOMIC DNA, CHROMOSOME 5, TAC CLONE: K24G6 (CYCLIN-DEPENDENT | 1E-54 | 121 | 260 |
| 254 | Histone acetyltransferase | eucalyptusSpp__015615 | Q9AR19 | Histone acetyltransferase GCN5 (Expressed protein) | 0 | 390 | 563 |
| 255 | Peptidylprolyl isomerase | eucalyptusSpp__017239 | Q8GWM6 | Hypothetical protein | 0 | 364 | 591 |
| 256 | WD40 repeat protein | eucalyptusSpp__018643 | Q93VS5 | AT4g18900/F13C5__70 (Hypothetical protein) | 0 | 229 | 327 |
| 257 | WD40 repeat protein | eucalyptusSpp__019127 | Q9SRX9 | F22D16.14 protein. SPTREMBL | e-131 | 232 | 337 |
| 258 | WD40 repeat protein | eucalyptusSpp__022624 | Q9LFE2 | WD40-repeat protein | 0 | 594 | 868 |
| 259 | WD40 repeat protein | eucalyptusSpp__032424 | Q8LPL5 | Cell cycle switch protein | 0 | 255 | 327 |
| 260 | WD40 repeat protein | eucalyptusSpp__037472 | Q9SK69 | Putative WD-40 repeat protein (AT2G20330/F11A3.12) | 0 | 461 | 677 |

SEQUENCE LISTING (782 sequences)

SEQ ID NO: 1 - DNA, 2267 bp, Eucalyptus sp.
caaaagggaaacaaggatttcaactcctgagattttaagtaactcaattagcagttccaacattaaaccattattattaccccttttatcagagctttttgacctggtttaggaaaattccaagaactcagccaaatcttcgacctttttgggtctgcaaaccttgcaaagaaagcccaactcagctggaggctggagatgaacatttccatggcggattcctgccaagattcaattttgatgacgcagagcgcgaaccaccaccttcccaccgcctaattactccctttccctctctctctctctctctctctctctataggaatttcggtcttcttcgaaggggcagtcgcactgtattggggaaaatctctccagtggcgaggatgggagacgggagcctcggctccggcggcaggggcaacagcggcggcggcggcggcggcggcagccggccggagtggctgcagcagtacgatctgatcggcaagatcggcgagggcacctacggcctcgttttcctcgcgcgaatcaagcatccatccaccaatcgcggcaagtacatcgccatcaagaagttcaagcagtccaaagacggcgacggcgtctcgcccaccgcgatccgcgaaatcatgctgcttcgtgaaatctcgcatgagaatgttgtgaagctcgtgaacgttcacattaaccccgtggacatgtcgttgtatctggcttttgattacgcagatcatgatctttatgaaattatcagacatcacagagacaaggttaaccaggccatcaatccctacacagttaagtcattgctttggcagctgcttaatggactgaattatctccacagtaattggatcatacatcgagatctgaagccatcaaatattctggtcatgggtgaaggagaggagcaaggcgtcgtgaaaattgcagactttggacttgccagggtctaccaagctcctttgaagccactatctgataatggggttgtggtaactatctggtatcgggcaccagaattgctgcttggtgcaaagcactatacaagcgctgttgatatgtgggctgtcggatgcatttttgctgagcttttgacattgaagccattgtttcaaggtcaagaagtgaaagccaatcctaatcctttccaacttgatcaacttgacaagattttcaaggtcttgggtcatccaacgcaggagaaatggcctatgcttgtgaatctgcctcattggcaatcagatgtgcaacatattcagagacacaagtatgatgacaatgcgcttggtaatgttgtacgtctctctagcaaaaacgctacatttgacctcctgtcaaagatgctagagtatgatcctcaaaagcgtataacagcagctcaagccttggaacatgaatattttcgtatggaacctcttcctgggcgcaatgcacttgtacccagctcacctggagataaagtgaattatcctactcgtcctgtagatacaactacagatattgaggggacaactagtcttcaaccttcacaatcggcatcatctggaaatgctgttcctggaaatatgcccggtcctcatgttgtgacaaataggcccatgcctcgtcctatgcatatggtcggtatgcaaagggtgccagcttcaggaatggccggttacaatctaaatcctagtggcatgggtggtggaatgaatcctagtggcatccccatgcagcggggagttgcgaaccaggcccaacagtctcgaaggaaggacccaggaatgggaatgggtggataccctccgcaacagaaacaaaggcgcttctaagggatctaatttactgcgagaaatttcgagacctttcagaaattatgtttgctctagtgatactggctgcagcatcatgcttgctttggtgacacgatgcaaagaactagactgcatcttaaggaaggaaaggcaactatcgacttcattaatgggctcatcctctgggggcttagaggcttcatcggcattggtgccgactatggcaggatggaataatcaacggctgttctgctaaatgcattggaagttgctgcagattcacagtgatagatatcaatggagaattggattccagcatcatagcactcgcaatctttagggatctgcctcaattttttgctgaggttataactcgctctttcagaaatgtcatcgattattgatgggcatgtccatcaatccgacacgtttccctaatgtacatcaattctgccaaaaaaaaaa

SEQ ID NO: 2 - DNA, 1364 bp, Eucalyptus sp.
ctgatctcgtcgccgccggccgcccgtcagagtcgctcccgccgcggcgcgcactcctccgaaccgttcgaattgtttgtccgttgaaaacccgcgagatggagaagtaccaacagctcgcaaagatcggggagggcacgtacgggatcgtgtacaaggccaaagacaagaagagtggtgaactgctcgctttgaagaagattcgtttggaggcggaggatgagggcattccctccactgccatccgcgagatttccctcctcaaacagctccaacacccaaacatcgtccggttgtacgatgtcgttcacacagagaagaagctgacactggtgttcgagttcttggaccaggacctcaaaaagtacttggatgcgtgcggtgacaacggactcgaaccgtacactgtcaaatctttcttgtaccaactgctgcaaggcatcgccttctgccacgagcaccgcgtgctccaccgcgatctcaaaccgcagaatttgctcatcaacatggagggtgagttgaagctggccgacttcggtctggcgcgcgccttcggtattcccgtccggaattacacgcacgaagtcgtcaccctctggtaccgcgcccccgacgtgctgatgggatcgcggaagtactccacgcaagtcgacatttggagcgtcggctgcatcttcgctgagatggtgaacggtcggccgctgtttcccggctcgagcgagcaggaccaactgctgcgcatcttcaaaacgctcgggactccgtccctcaaaacgtggccgggaatggcggagctgccggactttaaggacaatttccccaagtatgtcgtgcagagcttcaagaagatctgtccaaagaagctcgacaagaccggcctcgatctgttgtcgcggatgttgcagtacgaccccgccaagcgcatctccgccgagcaggcgatgggccacccgtacttcaaagacctcaagttgaggaaaccgaaggcggccggaccgggaccctaaaaaaaagccacccaactcacccaattcttcttctttttccatctttttttttcgttgtagtcaagttggtggtcggttgtcgggaaaatttatttcattgtttttttcttctcgagatttttcggttctgtgggtaccgtttccaaacaaaaaaacttttgcctgccgtgtcttcactttgcttccctctgctatttagctgtgaactttcttttttttctcattcgcttctttgggcgcgtgtgttcagtggggataagtgttctcgtttttctctgtacatactcgcgcttctacgcagcaaatcacgaagagaccgtgtttactgagcaaatatttttttctaataaaaaaaaa

SEQ ID NO: 3 - DNA, 1193 bp, Eucalyptus sp.
gccaacgccaacaccaccaccagcggcggcaacagcagcagcagcaacagcaaccggccgccattactgccccctccaggttgctgttgcattgcgcggcatctttgaactggagttgaatggatcagtatgagaagatcgagaagatcggggaaggaacttatggcgtggtctataaggctattgatcgctccaccaataagacaattgctctgaagaaaattcgtttggaacaggaagatgaaggagttccgagtactgcaatcagagaaatctctctcttgaaagaaatgcagcatggaaacattgtcaagttgcaggacgtagtgcacagtgagaggcgtctatatctagtttttgagtacttggacttggatttgaaaaagcacatggattcatgtccagaattttctaaggacacccacacaataaaaatgttcctttatcagatcctgcgtggcatttcctattgccattctcatagagttttacatcgagatttgaagccccagaatttgctgctagatcgtcgtactaattcattgaagctagctgactttgggctggccagggcttttgggattcctgttaggacatttacccatgaggtggtgactttatggtatagagctcctgagatactccttggatcccgccattactcaacgcccgttgacgtgtggtctgtgggttgtatatttgcagagatggtgaaccggcgaccactatttcctggggactctgagattgatgaattgtttaagattttcagaataatgggcacgccaaatgaagattcatggcccggagtgacctctttgcctgattttaaatcaacctttcctaagtgggcttcacaggacctaaaaactgttacgccaactgttgatccagctggcatcgatcttctttctaaaatgctgtgcatggatcctagaagaagaataactgccaaggtcgctcttgagcacgaatacttcaaggacgtcggtgtcataccgtgaatatcattgccttacttactcggtgagacatgtctatatggagtttgtagcatattaatgggttttgattgtgtgaaatgtgaatcttttcaattcttaaccgcatcttctttctcgagtcaaatacaagtcctgttgaactggattttggatgttttagccagcaaagttgatctcttaaaaaaaaaa

SEQ ID NO: 4 - DNA, 1139 bp, Eucalyptus sp.
ctaactctcatctaattcaaaaatggttatgaaaagtaaactggacaagtacgagaagcttgaaaagcttggtgagggtacttacggtgttgtatacaaggcccaagacaagacgaccaaggaaatatatgctcttaagaagatccgtttggagtctgaagatgaaggtattccaagtaccgcaattagagagattgctcttttgaaagaactccaacatcctaatgttgtcaggatccatgatgttatccacaccaataagaagctcattctggtctttgagtttgtcgactatgatcttaaaaagtttcttcacaactttgataaaggtatagaccccaagattgtaaagagtcttctttaccaactggttagaggagtggctcactgccatcaacagaaagtccttcatagagatcttaaacctcaaaatctgctcgtcagtcaggaaggtattctaaagcttggtgattttggtcttgccagagcctttggtattccagtcaagaactatacaaatgaagtcgttactctatggtacagagctcctgatattcttttgggatctaagaactactctacttctgttgatatttggagtattgggtgcatctttgttgaaatgctcaaccaaaaacctctcttccccggaagctctgaacaagatcaacttaagaagatcttcaagattatgggaacccccgatgccactaaatggcctggaatcgctgagctacctgactggaagcctgaaaacttcgagaaatatcctggagaacctttgaacaaagtttgtcccaagatggaccctgatggtttggatttacttgataaaatgttgaaatgcaacccaagtgaaagaattgctgctaagaacgctatgagtcatccctacttcaaggacattcctgataacttgaagaaattatataactagatacaaggttagctaggtatataatagcggtacaagtcttttttaaagtaatttacaaaaagatacttgattatcttagataagaattatatgtctgctaaacttggaatatgttgggtgagaatacatattctataattatataacaatttatatgtcgaaaattattatctaagctaataaataactattaaaaaaaaaa

SEQ ID NO: 5 - DNA, 1237 bp, Eucalyptus sp.
gggaagggaggtaccaaaataaaaagggagggcagagacgcgcacgctccccgaccaaagaagacacgcccccgcccagcgctggcgctaaacacccgccatttctgcaaccaggtatcgcgccggaaggacttttgacctgggctggatggatcagtacgagaaagtggagaagatcggtgaaggaacatatggtgtggtgtataaggccattgatcggctcaccaatgagactatagctttgaagaagatacgcttggagcaggaagacgaaggagtaccgagcaccgcgatccgagaaatctctctcctgaaggaaatgcagcatgggaatatagtcaggttgcaggatgtagtgcatagtgagaataggctgtatctagtttttgagtatctggacttggatttgaagaagcacatggattcatctccagactttgccaaggatcctcgtctggtaaaaatatttctttatcaaatactgcgtggaatagcatattgtcactcacatagggtgctccacagagatttaaagcctcagaatctgttaattgatcggcgtacaaatgccttaaagcttgctgactttggacttgcaagagcttttggtattcctgttaggacttttacacatgaggtggtgactttatggtacagagcaccagaaatacttcttggttctcgtcactattctaccccggttgatgtctggtcagttggttgtatattcgctgagatggtgaaccaacgtcctttatttcctggagattctgaaattgatgaactgttcaagatcttcaggatcttgggcacgccaaatgaggacacatggccgggagtaactgccttgccagatttcaagtctgcctttcctaagtggcctgcgaagaatctacaagatatggttccaggtctcaattcagctggaatcgatcttctatctaaaatgctctgcttggaccccagcaaaagaattacagccaggagtgctctcgagcatgaatacttcaaggacatcggatttgtaccctgattatcttttgccatttggtcaagattgttatatattggcctgtgtaggtgattctgctcttcttttaaggtgtgagttgtgcgtgatcccacatattcacatgttgcagtttctctgaagccttggacaaatcaagtagaacttctctcggcagcatcagtttttctaatccatgccttgttgcttgctgatccaaaaaaaaaa

SEQ ID NO: 6 - DNA, 1324 bp, Eucalyptus sp.
atctccctcctctcgacaaaattcaaattcctcgccgacgccgaccaccactttctctctctctcccgctcaacgttccaaaaacaccaaccgccccatttctagagagagaaacaagagagagaagagagcgagagagagagagagagagagagagagagagagagagcgatcggagatcggagatcggcggcggcgatggagaagtacgagaagctggagaaggtcggggaggggacgtacggcaaggtgtacaaggccaaggacaaggcgacggggcagctcgtggccctcaagaagacgcgcctcgagatggacgaggagggcgtcccccccaccgccctccgcgaggtctccctcctccagctcctctcccagtccctctacgtcgtccgcctcctctccgtcgagcacgtcgacggcggctccaagcgcaagccgatgctgtacctggtgttcgagtacctggacaccgatctcaagaagttcatcgactcgcaccgcaaggggccaaaccctaggcccgtccccgccgcgaccgtgcagaacttcctctaccagctcctcaagggcgtcgcccactgccacagccacggcgtgctccaccgcgatctcaagccccagaacctgctcgtcgacaaggagaaggggatcctgaagatcgccgacctcgggctcggccgcgccttcaccgtcccgctcaagagttacacgcatgaggtcgtcactctctggtacagagcgcctgaggtgttgctgggatccgctcactattcgatcggcgtggacatgtggtctgtcgggtgtatcttcgctgagatggtgagaaggcaagccttatttcctggggactctgagtttcagcaactgcttcacatattcaggctattgggaaccccaactgagaagcaatggccaggagttaccactttgagggattggcatgtttatccacaatgggaacctcaaaacttggcaagagcagttccatcccttggaccagatggggtggaccttctgtcgaaaatgctcaaatatgatcctgccgaaaggatctcggctaaagcagcacttgatcatcccttttttgacagtctcgacaagtctcagttctgataatgcctcggatatatggccgagtgttcgctggacggcctcttatgttctgatgtggtccttgtatttaccttaaaagttactttcactgcttaaagggtgcttctgtttgctaggcactcgacgcagccgtgtgtcatcatctcggtgatgaagtatcatgtaaccaatatcaatgaatctattttttgtcctttcaaaaaaaaaa

SEQ ID NO: 7 - DNA, 1209 bp, Eucalyptus sp.
gagagagagagagagagagagagagagagagagagagagaatggagagaccggcgacggcggcggtgtcggcgatggaggcgttcgagaagctggagaaggtcggggaagggacgtacgggaaggtgtacagggcccgggagaaggcgacgggcaagatcgtcgccctgaagaagacccgcctccacgaggacgaggagggcgtccctcccaccaccctccgcgagatctccatcctccgcatgctctcccgcgaccctcacatcgtcaggttgatggatgtcaagcaaggtcagaacaaagaaggcaagacggtactttacctggtgtttgagtacatggaaactgatttgaagaagtacatccgcggtttccgcagctctggagagagcatccctgtcaacattgttaagagtttgatgtaccaactctgcaagggcgtggctttctgccatgggcatggggtcttgcatagggaccttaagcctcacaatctcctcatggacaaaaagacgttgactcttaaaatagcggatcttggacttgccagagctttcacagtcccaataaaaaaatacactcatgagatactgactctttggtatagagctcctgaagttcttttgggggctactcactattcaaccgcggttgacatgtggtctgtcggctgtatatttgctgagttagtcaccaagcaagcactcttccctggagattctgaactgcaacagctcctacacattttcagactgttgggtactccaaatgaaaagatgtggccaggggttagcagtttgatgaactggcatgagtatccacagtggaaacctcaaagcctgtccaccgcggttcccaatctggacaaggatgggttggatctgctttctcaaatgctgcattatgagccctcgaggaggatttctgcaaaggcagccatggagcatccttacttcgatgacgtcaacaagacttgcctatgagactgcgcaaagtgtgtagattaggaaccgggatttggaattttagcgaactgaaaagacatgtactgaaaactaattgcttgcctcaagcatgaccttttgtgcaccatgtgcttctgtcaattaatatcttttctaggatgatatggttaatgcatcctcacgcttatatatatatctcaatttgtgtcaattgatgttgcaagcatgttatacgaaaaaaaaaa

SEQ ID NO: 8 - DNA, 2310 bp, Eucalyptus sp.
ggcagaatttcttgcttcctcccaccccagttccttcttttttaccgagcaagattgaccggggaggacacacgtttcacgcctcgctggaggagcttgcaccctgaccggagcaaggtgggtagatttgacttgctgatgcggagattgagctgcttgtgcttgggagtcgccttgttcttgcggtgagtgatccgtcggaggatattggtggctggtggctggtggggttaagaggccgtacacgagctgtatgggatatgttcagagatgaaaattagaagcgagacatgggttgcgtgcttggtcgagaggtgtcgtccggcatagtcacagagtccaaagggcgggatagttcggaggtcgagaccagcaagagggatgattcggtcgctgcgaaggtagagggagagggtaaagccgaggaggtgcggaccgaggagacccagaagaaggagaaggtcgaagatgatcagcagtcgcgggagcaaaggagacggtccaagccaagcacgaagctaggcaacctgccaaagcatattcgaggagagcaggttgctgctggatggccctcgtggctctcggacatatgcggggaggctctcaatggctggattcctcgaagagcgaacacgtttgagaaaattgacaagattggacaagggacatatagcaatgtgtacaaagccaaggatttgttgactggtaaaatcgttgcactaaaaaaggtccggtttgacaacttggaacctgaaagcgtgaggtttatggcacgagaaattctcattctacggcatctggatcatcctaatgttgtgaagttggagggtttagttacctcacgaatgtcctgcagcttgtacctggtatttgagtacatggagcatgatttggctggattagcagcaagtccagcaatcaaattcactgagccacaggtcaagtgttacatgcatcagctgctctctggactagagcactgtcacaatcgccgtgtgcttcaccgtgatattaagggctcaaatctactgattgacaatggaggagttcttaaaattggtgattttgggctggcttcattctatgatccagaccacaagcatcgaatgacaagtcgggtggtcactctgtggtatcgtccccctgaacttctacttggggccaatgattatggtgtgggtatagacttgtggagtgctggttgtatactagccgagttgttggcggggaagcccatcatgcctggtcgaacagaggtagagcaactccacaagatatacaaattatgtggctcaccttcagaggagtattggaagaaatataagttgccaaatgcaacattgttcaagcctcgagaaccttatagaagatgcatcagggaaacatttaaggacttccccccatcatctttgccacttattgaaactcttctggcaatcgatccagcggaacgcgggacagccactgatgctttgcaaagcgaattcttcaggacggagccatatgcttgtgaaccgtctagcctcccacagtatccccccagtaaggaaatggatgctaaaaaacgtgatgacgaagctcgacggttgagagcagctagtaaaggacaagcagatggttctaagaaagaacggacacgtgatcgacgtgtcagggctgtccctgctccagaagccaatgccgagcttcagcataacattgatagaagacgactcatttcccacgcaaatgcgaagagcaaaagcgaaaagttccctccgccacatcaggatggagcgcttggtttcccattgggagcttctcatcgttttgatccggctgttgtccctcccgatgtcccatttacctctacctcatttacttcttcgaaagagcatgatcaaacatggtcaggcccactggtcgaccctcccggtgctccaaggcgaaagaagcacagtgcaggcggacaacgagagtcttcaaaattatctatggggaccaataaagggagaagagcagattctcatttgaaagcatacgaaagcaaaagcatagcttaaacgatctaccggacggaagaccatttgttttacaaacacggaaaaagttagttcgagggtaaacttcactcggtatttgttatccatgtcaatgtttatttttttgtcccatggaggatttaaatttttgccgttaccgttttttggtttgttgggatggtcagtcaatgttggtgctgtaaatttttgcttcagtggcttcttggtaccaagtattccatattttttacactctgaagaattgaaataagtattgacaaaaaaaaaa

SEQ ID NO: 9 - DNA, 2684 bp, Eucalyptus sp.
atagaaagaggattggagttcttgagaattgtgagatgggtattgggtgttgagtgattctgtaaagatcaattctttttagagtgattcgttgattgttgcaacatgggttgcatgtattctaagagttcagcggttgatgacagccgagagagtcccaaagacagagtatcgtctagtaggcgattatcagaggtgaaaacttcaagattggattcatcgaggagagagaatgggttcagggcaagagataaggtgggtgatgtgagtgttatgttgatcgataagaaagtgaacgggtctgctaggttttgcgatgatcagattgagaagaagagtgatcgtcttcagaagcagaggagagagagagcggaagcagctgcggcggctgatcaccctggcgctggtcgggtccccaaggcggtagagggcgagcaggtggcagccgggtggccggtgtggctgtctgcggtggcaggagaggccatcaagggatggcttccgcgacgggcggacacttttgaaaagctggacaaaattggccaaggaacttacagtagcgtttacaaggcacgtgatgtcactaataacaaaattgtggctctgaaaagagtgcggttcgacaacctcgatactgagagcgtcaagttcatggcgagggaaatccatatcttgcgtatgcttgatcatcctaatgttataaagctggaaggcttgataacttcaaggatgtcctgtagcctgtaccttgttttcgagtacatggagcacgatcttactggacttgcgtcgcggcctgatgtaaaattttctgagccacagatcaaatgttacatgaagcagcttctaagcggtctcgatcattgtcataaacatggggtcctacaccgggacataaagggctcgaaccttctcattgacaacaatggcatcttgaagattgcggattttggtttagccagcgtctttgatcctcatcagaccgctccgctgacaagccgggtggtaactttatggtaccgaccacctgaacttttgcttggagcttctcgctatggagttgaggtggatttgtggagtaccggctgtatactaggtgaactctatactggcaagcctatattgccagggaaaacagaggtggagcaattgcataaaatttttaagctttgcggttcaccgtctgatgattactggagaagattgcatcttccccatgcagctgttttcaagcctccacaaccttatcgacgatgtgttgcggagatattcaaagaactccctccagttgctttgggcctcttagagaccttaatctctgtagatccttcacaaagagggacagcagcttttgctctcaggagtgagttctttacagcaagtccccttccttgtgatccttcaagtctgcccaaatatccaccaagcaaagaaattgacatgaaattgcgggaggaggaagcaagacggcgtggagcagctggaggaaagaacgagcttgaaaagagaggaaccaaagattcacgaacaaattctgcatattatcctaatgcaggacaattgcaggtcaaacaatgccattccaatgcaaatggccgaagtgaaattttcggcccttatcaagagaaaactgtgtctgggttcttggttgcaccccctaaacaggcgcgagtttccaaggaaacaagaaaagattacgcagagcaaccagatagagcttcattctcgggaccactagttccaggtcccggattctccaaggctggaaaagaacttggccattcaatcactgtctcaagaaacaccaatctatcaacactgtcgagtttagtcactagtagaaccggagataacaaacaaaaatccggtcctttagtgtcagaatcagcaaaccaagcaagcagatattcaggacccataagggagatggagcctgcgaggaagcaggaccgtaggagtcatgtgcggacgaatattgattatcgttcgagagaagatggaaattccagtaccaaagaacctgctctgtacggacgtgggtctgcaggaaacaagatctacgtctcaggcccgttgctcgtctcatcaaacaatgtggatcagatgctcaaagagcatgaccgtcgaatccaagaacatgccaggagagcacggtttgataaggctagagtgggcaataatcatccccaagcagccgtcgactctaagctcgtgtccgtgcacgatgccgggtagattccctgcaaagagctactaaatgtcagatatatcttcaaagctgggcaagcttacttgcctatgcgaagggaagcgcatatagaggcttagcagggtagctcatccatttggtttgggatttatcttatatgtatagtcggcatctttctctgctcattcttatttattttcatggtagcgaggtgggatctctggtaaggaagagtcggccaccttttagtacactatgtaatacatagtttacgacaggatatagcagaattagaataaggtcaatctagaaactgatttgtttctgaatggcgcgccgcgcacgcagcaagcgcttgtaaccagtgttaagagaaaaaatgcatcgcatcgtcacttgaacggcctcttcggctttaagcggtttgcttggcgagagcaagtaagacgttttcaattgttctaaaaaaaaaaaa

SEQ ID NO: 10 - DNA, 1957 bp, Eucalyptus sp.
gctggagtgccgaccgaagcacctccgagtcttcctcctcccctccaccgcgtgctgcggtggctgaccgcatgataccagatgggttgcatccccaccatcatctccgacggccgccgccgctccgccgcccccgacaaacgccgcccccgccctcgccggagctcgagcgagggggaggcgccgccccacgccaccgccgcgggctctgaggggggtgagtccgcccgcggtgctccggggaaggagaggccggagccggcgccgcgtttcgtcgtcaggagcccgcagggctggccgccgtggctggtcgccgcggtggggcatgccattggcgagttcgtccctcgctgcgccgatagcttccggaagctcgccaagattggggaaggcacgtacagcaacgtgtacaaggcgagggatctggtgacggggaagacggtggcgctgaagaaggtcaggttcgataatctggaggcggagagcatcaagttcatggcgcgggagattctggtgttgacgaggctcaaccaccctaacgtgatcaagctcgaggggccggtcacttcgcgcatgtcgtcgggcctttacttggctttcgagtacatggaacatgatctctctggaatcgcggcccgccagaatggcaagttcactgagcctcaggtcaaatgttttatgaggcagctgttgtcagggcttgagcattgccataatcatgatgtcctgcaccgtgatattaagtgctccaatttacttattgacaatgaaggaaacctgaaaatagctgattttggactggccacattctatgatcctgagcgcaagcaagttatgaccaatagagtcgttacactatggtaccgagcaccggagcttttgcttggggccaccagctatggaattggcattgacctctggagtgcaggctgcattttggcggagttactgtatggaaagccgattatgccaggacggacagaggtagagcaactgcataagattttcaaattatgtggctcaccatctgaagcatattggaacaaattcaaattgccaaatgccaatattttcaagccgccacagccttatgctcgttgtatagcagaaacattcaaggactttccaccatctgctctgcctctccttgagactctgctttcgatagaccctgatgaacggggcaccgccacaacagcactaaatagtgaattctttgctgctgaacctcatgcatgtgaaccatcaagcctgccaaagtatcccccaagtaaagagatggatctaaagttgatcaaggaaaagacgagaagagattcaagcaagagacccagtgcaatccatggttccagaagagatggaattcatgatcgagctgggagggtaattccagctccagaagccactgcagagaatcaggcaactctccataggccgagagctatgaagaaagccaaccccatgagcagaagcgagaaattcccaccagcccatatggatggagtggttggatcttctgctaacgcatggctatctggtccagcatcaaatgccgcacctgattcccgtcgacaccgttcacttaatcagaacccatcaagttcagttggaaaggcttcaactggatcctccacaacccaggaaacgttgaaggtggctcccgagttgttgcaggtgggaagctcatccttgcatccatgccatcggatgcttgtttatggatccaatctcacgatcagaagtaaatagttggtgcctctggctctggatgctttctgtaaatgggaaaagaagagcagcacacagactcgataatctttttgttggctaggatcctttagattctttttccccacacaagttctgtatcttttttcagagagtaaccatttgttggacaaaagaataaagattctgcattgtcaatgtcaacctattccttctgttaaaaaaaaaa

SEQ ID NO: 11 - DNA, 2572 bp, Eucalyptus sp.
ggggtttccttacttcttcacagatgtaatgcacgttccttcctgcaagaaggtggggtgtatcctcccccccgtacatggtcgtttcctgatgcgggtcaatcaccgtttcatgtaattcgatccaatgcggtcggtgcatcgcagctgatgggctgcatatgcgcaaagcaggcggaccggggaccagcgtcgcctggttcagggatcttgactggagcgggtaccggtaccggtaccaggtcgtcgaagatcccatccggtctgtttgaattcgagaagagcggtgtgaaggaacacgggggtcgtagcggggaattgaggaagttggaggagaagggttcattgagcaagagattgaggttggagttgggattttcacatcggtatgtggaagccgaacaagcggctgcaggatggccttcttggctcaccgccgttgctggtgacgcaattcagggattggttcctcttaaagcagattctttcgagaaattggagaagataggacaaggcacatacagcagtgttttccgagcaagggagttggcaaatggaaggatggttgctcttaagaaagtccggttcgacaactttcaacccgagagcattcaatttatggcacgagagatatcgatcctccgcaggcttgatcatccgaatatcatgaaactggagggcataatcacttctcgaatgtcgaacagcatttatcttgtgttcgagtacatggagcatgacctttacgggctaatatcttctcctcaggtcaagttcagcgatgcccaggtcaaatgctatatgaagcagcttctgtcaggaatagagcattgccaccagcacggagtgattcatcgagacgtaaagtcttcgaacattctggtgaacaatgaggggattcttagaataggagatttcggactggctaacattcttaatccaaaggacaggcaacaactcaccagtcatgtcgttaccttatggtaccgtcctcctgagcttctcatgggttccacaagctacggcgtgactgtggatctgtggagcgttggctgtgtttttgcagaacttatgtttcgaaagcctattctcagagggagaacagaggttgagcaattgcacaagatttttaaactctgtggttccccgcccgatggctactggaaaatgtgtaaggtaccccaggccaccatgtttagaccccgccatgcttatgaatgcactctgcgagagagatgcaaaggtattgcgaccagtgcaatgaagctgatggagacttttctttccatagaaccgcacaagcgtggaactgcttcaagtgcgctcatatctgagtatttcaggacagtaccatatgcatgtgatccatcaagcttgcccaagtatcctcctaacaaagaaattgatgctaaacatcgagaagaggcacggaggaaaaaggctcgttctagagtacgagaagccgaagtagggaaaaggccaacaagaatccatagagcttcgcaagagcaggggttttccagtaacatagctccaaaagagaagagaagctatgcctgagagcttggattcaaacctcttccttgatagagatgctcacaagcaccttgcttcttcgccatcaggatgtctcggttttatagtcgaatgctcttgtaatccaacaatttcaatgttgattgcccaggagttgcaaggccaggctcagtttgttcggagaaatcatgtgagaagtaacctgaagggagaaattgatgttccatgtagagagcctctgaagtcatcttgcgatgcctcggcgacttctgaagtggcggacacgtctcaaggaccgagtattttatcgggtccaacacagatcagtgcgtcaaatggctttgcatgggcgagaaggcgaaaggatgattctgttctgaaaaggtcatatagtaggtctagcgccagaagtcaagttagtgcactcgattcatcaagcatcgtgttcgaaccccatgacacggatgcaaacggaagcaccatgcatgaactgcggaaactcggaatcgagcttgatcaggatgattcctttgaagtacttgtgttgagggctaatacatcccgatctgaagttgaatcgatgaagtgagtgaatgagaatgatacttgaagttcggcatcgacaaagtggttacagacattgacaaagtagttctagtcaccgttgttgtgaaggtagttatagccatcgattagacagtgattaaagtagtacccgtgccaatgaagtgccgtccaaatgctcagccacactgcggtcgacagaattcgatttctggttggctacgagttgctgatatcgcgacatggctggggcagatgcagtgaaagaattacccacaacatgcaggatagggtgtttgtaacacgcttgattttcaactcgaatgctcttcatatgaatgtaaccaatttcctctaggatttctctatggactaggatgtaaccaggcctcccctcaaaagtagatgaaacgctttatgctttatctttcttttccttggaatgtacgccttacttcctttaaaaaaaaaa

SEQ ID NO: 12 - DNA, 1945 bp, Eucalyptus sp.
agggtgacctaaatcgtttataccttgctcaggctagtgagagaaagagagagagatagagagagagagagagacagagagatggccgtagcagcgccgggccacctcaacgtcaatgagtccccgtcgtggggatcgcggagcgtcgactgcttcgagaagctcgagcagatcggcgaaggcacttacggtcaagtttacatggctaaagagaaaaaaactggtgaaatcgtggctctgaagaagattcggatggacaatgagagagaagggtttccaataactgccatacgtgagatcaaaattttgaagaaactccatcatgaaaatgtgataaagctgaaggaaatcgtgacttctccaggtcctgaaaaagatgagcaaggaaggccagagggaaacaagtataagggtggcatctacatggtttttgaatacatggatcatgatctaactggccttgccgaccgtccagggatgagattttctgttccccaaataaagtgctatatgagacagcttttgacagggcttcattattgtcatatcaatcaagttcttcatcgtgatataaaagggtctaatcttcttattgacaatgagggaaacctgaagcttgcagactttggcctcgctcgatctttctcaaatgatcacaatgcaaacctcaccaaccgtgttataacattgtggtatagacctccggagttgctgcttggggcaacaaaatatggtccagctgttgatatgtggtctgtgggttgcatctttgccgaacttctccatgggaagccaatttttcctggaaaagatgagccagagcaattgaacaagatttttgagctttgtggagctccggatgaaattaattggcctggtgtctcgaagattccctggtacaacaacttcaagccaacccggccaatgaagagacgcctcagggaggtattcagacattttgaccggcatgctttggagttactagaaagaatgttaacactggatccttctcagagaatttctgccaaggatgcgttggatgcagagtatttctgggctgacccattgccttgtgatccaaagagtttgcctaaatatgagtcatctcatgagttccagacgaagaagaagcgccagcagcagaggcaacacgaggaaacagccaagcgccagaaactgcagcatcctcctcagcatccccggctgccacctgttcagcagtcagggcaagcgcatgcacaaatgaggccaggacctaaccaactcatgcatggttcccagccccccgtggcgacaggcccgccggggcaccattatggaaagccccgtggaccatcgggaggagctgggaggtatccttccagtggaaacccaggcggtgggtacaatcacccaagtcgcggtggtcaaggaggtagtggaggttacaacagcgggccatatcctcctcaggggcgagctccaccgtatggttcgagtggaatgcctggtgctggacctcgaggtggcgggggtaataactatggtgttggtccatcgaattatcctcaaggtggtggtggtccttacggtgggtctggtgctggtcgtgggtcaaacatgatgggcggtaaccggaatcagcagtacggctggcagcagtgaatttccactggtcgctgctattgtgggcaaaaggtttttgaattgcgagtgtagttttttatgatgacactatttctgcgaaagagcaaagaggatccacatacaagagttgttacgctacacatcctataccatcaaaggaacgttggaatgccagcattgctgtttcatgattgatacgtgtatgtaaaatcaatgtggaagcattgtaatcttggctttgtcgaggctttgcttgaataatggtttccaatcggtttcaatgacggcgtacagacccacttgtttcgggaaaaaaaaa

SEQ ID NO: 13 - DNA, 3154 bp, Eucalyptus sp.
tggcattggatttgattagcgagttgacgcaacaatctgtcccaaccctctgtctctcacatccaccggctcttcgccttttcagggtccaggcttgatccgcaattctctccctctcttttcctctctttctctctctctctctccctccttccttgcccctcccgcctcacatttcgaagcaaaaaccaacttggagcagacgttatggttttttagacatttcccatttaggattttcctcgtggcagctcggaagttcggacgtttggttcccatccttgttcttgttccaaggcattgggggtttctcagcataggagggaagtagggacggtcatttgccacctcgaagttaatttgggttgcaaataaggacggagaactttggttgattttctggatcagggtttttcctcattcgtttttgccataggattaagcatttcttggttttcgcattgaagcaattcaccaagggaaagttgtagagattgataggaattaagatcctctggtttcttttgggaatgctgatcgatgacagtctcaattttagaaaagaggggtttctctcggaaccggtactttgatttgacgaagagggcaaatttgaagtgggataatgggttgcatttgcaccaaaggaattcttcccgcccattacaggattaaagacgggggtttgaagcttagcaaatcttcaaaaaggtctgttggatccttaaggagagatgaactggcggtttcagccaatggtggaggcaacgatgctgcagatcgactgatatcaagcccacatgaggttgagaatgaagtggaggataggaaaaacgttgatttcaatgagaaactgtcaaaatcccttcaaagacgagctacaatggacgtggcaagtgggggacacacacaagcacagttgaaagtgggtaaagtaggtggctttccccttggtgagagaggagcacaagtggtagccggatggccttcttggctgacagcagtggccggagaagctattaacggatgggtgcctcgaagggccgattcatttgagaagctggaaaagattgggcaaggtacttacagcagtgtatatagagcacgtgacctggaaacgaatacaattgtagccttgaaaaaggttcgatttgctaatatggacccagagagtgttcgattcatggcaagggagataattatcatgcgaaagcttgaccatccaaatgtcatgaagctggagggtttgataacttcaagggtttctggcagtctgtatcttgtgtttgaatatatggaccatgatcttgctggcctcgctgccactccgagtataaagctcactgaatctcagatcaaatgttacatgcaacaactacttcgtggacttgaatattgccacagccatggtgttctacaccgtgacataaaaggctctaacttgttagttgacaacaatggcaatctcaaaattggagactttggattggcaacttttttccggaccaatcaaaagcagcctctaacgagtcgcgtagtcactctctggtaccgacctcctgagctgttgcttggttcttcagattatggagcttctgtggatttgtggagttctggttgcatcctagctgaattgtttgctgggaagcccataatgcctggaagaacagaggtggagcaattgcacaaaattttcaaactttgtgggtctccgtcagaagaatattggaagaagtcaaaattgccacatgcaaccattttcaagcctcagcaaccttacaagcgttgtctcctggagacatttaaggattttccttcatctgcattgggcctgctagatgttcttcttgcagttgaaccagaatgccgtggaacggcttcctcagcccttcagaatgagttcttcacatccaatcctcttccaagtgatccgtcaagtttgccaaagtatccatcaagcaaggagtttgatgccagacttcgagatgaggaagccagaaaacataaagctactgccggtaaagctcgtggtcttgaatcaattagaaagggttcgaaagagtctaaagttgtgcctacatcaaatgccaatgctgatttaaaggcatccatccagaagcgacaagagcaatcgaatcccagaagtaccggtgagaaaccaggaggaacgacccagaacaatttcattctatctggacaatcagcaaaacccagtcttaatggatcaacacaaattggaaatgcaaatgaggttgaggctttgattgtgccagaccgagaactcgattctccaagaggtggggccgagttgagaaggcagagatctttcatgcaaagaagagcatcgcagttatccaggttttctaattctgttgcagtgggaggtgattcgcatctcgattgtagtagggagaagggtgctaacacccaatggagggatgagggttttgttgccaggtgtagtcatccagatggtggtgaattagcgggaaagcatgactggtcacatcatttgttacataggccgatatctttgtttaagaaggggggagagcactcccgaagggattccattgcgagttattctcccaaaaagggccgaatccactattctggacctttgcttccctcaggagataacctcgatgaaatgctcaaggagcatgagcggcaaatacaaaatgccgtccggaaagctcgccttgataaggtcaagacgaagagagagtatgccgatcacgggcagacggagtcacttctctgttgggcaaatggtaggtgattgtaaggatgacaaggagtaagtgcatttctctcttgaagcaaggaggcccatgagacggcaacaatgtcgacaggaagcagaattcctatccagaagcggtaaaagatatgatcgacacaagcattttgtgttggagcctcagctaattgtatgtcatcgagtactttttcgaagcacttgatgatgctccttgtgtcgtatgaaatccgaagcaatcggatttggtaaaatcaggtggcggtcttgtttggtgctccaacaatggaaagggctgtatattgtcaatgtttactctgattgttggaaggattctctgtacagtgatggcccatccctatctattcattgactgttccctgaaaaaaaaaa

SEQ ID NO: 14 - DNA, 1706 bp, Eucalyptus sp.
cttcgagctccgatggacccggacccgagcccggacccggacccgccgaagagctggagcatccacacccggcgggagatcatcgcccggtacgagatcctggagcgcgtcggctccggcgcctactccgacgtctaccgcggccgccgcctctccgacggcctcgccgtcgccctcaaggaggtccacgactaccagtccgccttccgcgagatcgaggccctccagatcctccgcggctccccccacgtcgtcctactccacgagtacttctggcgggaggacgaggacgccgtcctcgtgctcgagttcctccgcagcgacctcgccgccgtgatcgccgacgccagcaggcggccgagggacggcggcggcgggggggcggcggcgctgcgggccggcgaggtcaagcggtggatgctgcaggtcttggaaggggtcgatgcttgtcaccggaactcgatcgttcatcgcgacttgaagcccgggaatttgctcatatcggaggagggagtgcttaagattgctgattttgggcaggcaaggatactcctggatgatggaaatgttgctccagactatgagcctgaatcattcgaagagagatcatcggaacaggctgatatccttcagcagccagaaactatggaggcagataccacatgccctgaaggtcaagagcagggagctatcactagggaggcatacctcagagaggtggacgaattcaaggctaaaaaccctaggcatgaaatcgacaaggaaacaagcatatttgatggcgatacttcttgtctggccacatgcacgaccagtgacattggagaagatccttttaaaggttcctatgtttatggggccgaagaagctggagaagatgcacaaggctgtctcacatcttgtgttgggacacgctggttcagagcacctgaactgctctatgggtccacagactatgggctcgaggttgatctctggtcactgggatgcatttttgctgagcttttgactctggaaccccttttccctgggatttccgatatcgaccaacttagtagaatcttcaatgttttgggcaacctgagcgaggaagtctggccaggctgtacgaaacttccagattatagaacaatttcattctgcaaaatcgaaaaccccatcggtttggaatcctgcctgccgaactgctcaagtgatgaagtctctttagttcggcgacttctttgctacgatccagctgcaagagccactcccatggaactgttgcaagacaagtacttcactgaagaaccacttccagttccaattagtgcgcttcaggtgccccagtcaaagaatagccatgatgaggactctgctggtggttggtatgactacaatgacatggactcggattctgattttgaggactttggccctttgaagttcacacctacaagtactggtttctctatacagttcccctagtcatcgtgagaatgcagggatcaaatttgtgagtacttgctaaaatttttgctacggataatgttgtgaggcgaggcagtcgaaattacggaggttgacttctttcgacattcatatgcttgctgttatagacaagggggacgtgtctgtaaaagaccatgagagggttatattctcggtgtccttttgtcttgtaaatttccttcaccagagacacaaattcccatcgaaaaaaaaaa

SEQ ID NO: 15 - DNA, 1792 bp, Eucalyptus sp.
ccaaaaaagaagaaaagagaagaagagacgttccgtctgactggtctcgctgcaaaagctccgccgggagtcccctccacgccgccgtcactctctccctctttgagctccgatggacccggacccgagcccgagcccggacccgccgaagagctggagcatccacacccggcgggagatcatcgcccggtacgagatcctggagcgcgtcggctccggcgcctactccgacgtctaccgcggccgccgcctctccgacggcctcgccgtcgccctcaaggaggtccacgactaccagtccgccttccgcgagatcgaggccctccagatcctccgcggctccccccacgtcgtcctactccacgagtacttctggcgggaggacgaggacgccgtcctcgtgctcgagttcctccgcagcgacctcgccgccgtgatcgcggacgccagcaggcggccgaggggcggcggggtggcgccgctgcgggccggcgagggcaagcggtggatgctgcaggtcttggaaggggtcgatgcttgtcaccggaactcgatcgttcatcgcgacttgaagcccgggaatttgctcatatcggaggagggagtgcttaagattgctgattttgggcaggcaaggatactcctggatgatggaaatgttgctccagactatgagcctgaatcattcgaagagagatcatcggaacaggctgatatccttcagcagccagaaactatggaggcagataccacatgtcctgaaggtcaagagcagggagctatcactagggaggcatacctcagagaggtggatgaattcaaggctaaaaatcctaggcatgaaatcgacaaggaaacaagcatatatgatggcgatacttcttgtctggccacatgcacgaccagtgacattggagaagatccttttaaaggttcctatgtttatggggccgaagaggctggagaagatgcacaaggctctctcacatcttgtgttgggacacgctggttcagagcacctgaactgctctatgggtccacagactacgggctcgaggttgatctctggtcactgggatgcatttttgctgagcttttgactctggaaccccttttccctgggatttccgatatcgaccaacttagtagaatcttcaatgttttgggcaacctgagtgaggaagtctggccaggctgtacgaaacttccagactatagaacaatttcattctgcaaaatcgaaaaccccatcggtttggaatcctgcctgccgaactgctcaagtgatgaagtctctttagttcggcgacttctttgctacgatccagctgcaagagccactcccatggaactgttgcaagacaagtacttcactgaagaaccacttccagttccaattagtgcgcttcaggtgccccagtcaaagaatagccatgatgaggactctgctggtggttggtatgactacaatgacatggactcggattctgattttgaggactttggccctttgaagttcacacctacaagtactggtttctctatacagttcccctagtcatcgtgagaatgcagggatcaaatttgtgagtactacgtaaaattttgctacggaggcgaggcagtcgaaattacggaggttgacttctttcgacattcatatgcttgctgttatagacaagggggacgtgtctgtaaaagaccatgagagggttatattctcggtgtccttttttcttgtaaatttccttcaccagagacacaaattcccatcgacttgtcaaaaaaaaaa

SEQ ID NO: 16 - DNA, 2137 bp, Eucalyptus sp.
ggaatcgagaaaagtccctctccctctctccatctctccatctctccttccttttttggaagaaaggttgtgggggatacatcatcgccgttgggaaacggagagggggttaccggagcgggcggggggagatagcgattcgtgttgaactgctggtctcgccgccgccgccgccgctcctcgagatgtcgaaccagcaccggcgctcctccttctcgtcctccacgacgtcgtccctcgccaagcgccacgcctcctcctcctcctcctccttggagaacgccgggaaggccttcgccgccgccgccgtcccgtcgcacctcgccaagaagcgggcccccctcggcaacctgaccaacctcaaggccggcgatggcaattcccgcagctcatcggcaccatccactttggtggctaatgcgacgaaactggcaaagacgaggaagggatcttctacttccagctccatcatgggcctctcgggaagtgctttaccgagatatgctagcacgaaacccagtggagttcttcctagcgttaatccttccattccaagaatagagatagccgttgatcccatgtcgtgcagcatggttgtttcgcccagtagatctgacatgcaatcggtttcgctggatgagagcatgtccacctgcgagtctttcaagagtcccgacgttgagtatatcgacaatgaggatgtttcggcagttgattctatcgacaggaagacatttagcaatctttatatctcagatgctgcagcaaaaacagcggttaacatttgcgagagagatgtactcatggaaatggaaacagatgagaagattgtcaatgttgatgacaactactcggatccgcaactctgtgcaaccattgcttgtgacatttaccagcacttacgtgcatctgaggccaagaagagaccttccactgattttatggatagagtacaaaaggatataactgccagcatgcgtgccatactaattgattggcttgtggaggtggctgaagaatacaggctcgtacctgatacactgtacctgactgttaactacatagatcggtatctttcaggaaatgtgatgaatagacaacgtctgcagctgcttggtgttgcttgcatgatgatagctgccaagtacgaggagatctgtgcacctcaggtggaagagttctgttatattaccgacaatacgtacttcaaggaggaggtattgcaaatggaatcttctgtgttgaattacttgaagtttgaaatgactgctcccactgtcaagtgctttttaagacgatttgttcgtgctgcgcaaggcgtgaatgaggttccatctttgcaactggagtgcatggccaactatattgcagaactctctctactagagtacgatatgctttgttatgctccatctcttgtagctgcatcagcaatatttctggccaaatttgtcatcaccccttcgaagagaccatgggacccgacgttgcagcattacactctctaccagccttccgatctgggaaactgtgtcaaggatctgcatcggctgtgttttaacaaccatggttcgaccttaccagcaatcagggagaagtacagccagcataagtacaaatacgtggccaagaagtattgccctccctcgatacctccggagtttttccacaatcttgtctattagccgttgacgacactctgctccaatgctccgttggaacctatcctccgtttgcgcaccagcaactcttacgtgctttcgccccataatccggtgattgtcaaagagtgttgatctgtattcacttcgtaagattttaggatctctgtccctttccccatcttcgttgctgaagtgtaaatcccctcctctctttcgagttccgtcattttattttgcaccgttgatgatgttgtactctggtgcacgcggttgattttagcccggctgcatggccgtacggaggattagtagcttctttatgatgaaatgtcgtggcagatttctttttttctttctgttctgttttgattgctcttttttcctccatagaatgagctcacttctgcgcagaagttggtgaagataccggtaagttgactgctaatgtgaaatttgagctcccaaaaaaaaaa

SEQ ID NO: 17 - DNA, 2261 bp, Eucalyptus sp.
gctttctctttcctcctggcgagctttctctctctacatctctctatgcggacctcctccgaggggtcgcggagctccagcacaacagcgttacttgttctttacacttggcttttcgaatttcatatcgagcatctgcagaatgtttgttccctctttgtcatgatacaaggatagtgggtgcaatgaggagccatttgatttgatgacacgtacttccttgggaggagtgcaaatatgaacaaagaaaatgcagttggaacaaaaagtgaagcacccactatccgaattacccgatcaaggtctaaagcattgggcacgtcaacagggatgctcccatcctcaaggccctcctttaaacaggaacaaaagcgtactgtccgtgcaaatgccaagagatcagcatcagacgagaacaaaggaactatggttggaaatgctagcaagcagcacaaaaagagaacagtacttaatgatgttactaacatcttttgtgagaattcatactcgaattgtctcaatgctgccaaagctcagaccagcaggcagggtagaaagtggtctatgaagaaggacagagatgtgcatcaaagtggagctgtccaaataatgcaggaggatgtccaagcgcaatttgtagaagagtcgtccaaaataaaagtggcagagtctatggaaatcactatcccagacaaatgggcaaaacgagaaaattcagagcatagtatctcgatgaaggacactgtagcagagtcttcaaggaaaccacaagaatttatatgtggtgagaagtcagcagcactagttcaaccaagtatcgtagatatagattcaaaactcgaggatcctcaagcttgcaccccatatgcacttgacatatacaactataaacgcagcacagagcttgaacgaagaccttcaactatatatatggaaaccttgcagaaagatgtcactccaaacatgcgtggaattctagttgactggcttgttgaggtttctgaagaatataaactagttcctgatactctttacctcactgtgaatctcatagaccgatctctctcacaaaagtttattgagaagcaaagactccaattgcttggtgttacttgcatgctaattgcctcgaagtacgaggaaatctgtccaccacgagtggaagagttttgctttatcacggacaatacctatacaagcctagaggtattgaaaatggagagtcgagttctaaatcttctgcattttcagttgtccgttcccaccgttaaaacatttctgaggagatttgttcaagctgcccaagtatcgagcgaggtcccttctgttgaactagaatatttggcaaattatttggcggagttaactctcgttgagtatagtttcttaaagtttctgccttcccttatggctgcatctgctgtacttcttgccagatggacactcaatcaatctgacaacccttggaatctaactctagaacactacacaaagtacaaggcatcagagttaaaagctgcggttcttgcattggaagatttgcagctcaacaccagtggttccaccctaaatgcgatacgtgaaaagtatagacaacagaaggtaaactattcattactgatccatagcaaggccaatcatgagatattatagaccacacatttttgctaaactgttggagttcatagaactagacgttttccattgacacttgatcaactgatcatggcagttcaaatgcgtggcgactttaactccctctgaacctgcactttcactcttccaaagatttaactacagctgatcttcctgaagggctaacttgagaataatcaaatggagtgacttcccacattgcggcacttccagggtgaattcgagctccactaataggatgtctacttaccattttttgtcgaccgaggttttgttgtccacattaatgttctcattgttgtagcatttatttacggtctggtgcttccagaacagtcccttaatgatgaggaactctcagatcatgaccccataccaggcggcaaaacattgcgccgctcggcaataaacctcggagttttcctagtctctaggaactcgtacagtaaccccatttcttttgcttgcccgagtgtcaagctttcagatgtactgtttagtcacattacttctccgaaagaagatttggagatcattctctttgtacttcaatgaatttaacagaacgatactggaatctctctgttactcgttcaaaaaaaaaa

SEQ ID NO: 18 - DNA, 1877 bp, Eucalyptus sp.
gctactgccccacacacactctctctctctctctctctccttttcccccaaatcaataagaagagacgacgactgtgtagtagtgagggaagcggccgcaaaccgggcggtactgaaattttgatggagggtttcgggggaatctctctctgctgctgatctccgggagggctggttcgtcttcggcttcgggagggggaggagcgggagatcgtgatttcgaaggaggcagagatggccggatcggacgagaacaacccgggcgttgtcggaggtgcgcacgttcaagagggcttgcgggtcggagcggggaagatgggtgcggggaatgttcagcagagacgagctctgagcaacatcaacagcaacatcatcggggctcctccttatccatgcgcggtcaacaaaagggtcttgtccgaaaaaaatgtcaactctgaaaacgatctcctcaacgctgctcatcggccaattactaggcagtttgctgctcagatggcttacaagcagcaacttagacctgaggagaacaagaggacgacccaatcagtctcaaatcccagcaaatctgaagattgtgccatcttagatgtggatgacgacaagatggctgatgactttccggtgccaatgtttgtgcaacacaccgaagcaatgttagaagaaattgatcggatggaggaggttgagatggaagatgtagctgaagaacctgtcacggacattgacagcggtgataaagagaaccagttggctgttgttgagtacattgatgacctatacatgttctatcagaaagccgaggcttctagttgcgttcccccaaactacatggatcggcagcaggatattaatgagcggatgagaggtatactaattgactggctgattgaggttcattacaagtttgaattgatggatgagaccttgtatcttacggtcaatctcatcgatagattcttagctgttcaacctgtagtgaagaaaaaactccagctagtaggggtaacagccatgcttctggcatgcaaatatgaagaggtctcagttccagtagtggaggatctcattctgatttcagacagggcttatagcaggaaagaagttctagaaatggagcggttgatggtgaatactttgcactttaacatgtcagtgcctactccttatgttttcatgaggagatttcttaaagccgctcaatctgacaagaagctcgagctcttgtcattcttcatcatcgagctttccctggttgaatatgacatgctgaagttcccaccctctttattagctgcttctgcaatctacactgctctgagtacaattaccagaactaaacagtggagtacaacatgtgaatggcacaccagctactcagaagaacagcttctggaatgcgccagattgatggtgactttccatcagagggctggatcagggaagctcactggtgtgcaccggaagtatagcacatccaagtttggtcatgctgcgagaactgagcctgctaactttctcttggacttccgtttgtagtgggttgcgtgtgtcgttgtgtaccttgcctaaatcaaacataaaaaactgacttttgggccagggtggggggcttaaaaatatagcaacataagttgccctgcgagtgtgtgtatagctgattcatttcagcgttttatctgaacatatgatggtgattcattccttgtatcccttgaacatatatgatgccgattcatttcagcgttttatttgcacctgacagtggatagctgttgtttgttgacactgttccttagttgcatttattcatcgattttcattgttgccaatgatgatgttactagcaataacatcccttgaacttaaaaaaaaaa

SEQ ID NO: 19 - DNA, 1872 bp, Eucalyptus sp.
aagcagtggtatcaacgcagagtacgcggggattctcgtttcttcctgcacaggatctcactgtgagagagaccagaggagaaggcacaggttctctcgtgggtagggtttcgcctcgccaatcagattcggaggagctttttgttctttgatcgaaatggcttcaagacccattgtccccgtgcaagcgagaggcgaggcagcgataggaggaggagcgggtaaggcagcgataggaggaggagcgggtaagcagcagaagaagaacggcgcagcagaaggaagaaaccgcaaagccctcggcgacattggcaatctcgtcactgttcgaggcatcgaaggcaaggttcagcctcatcgccccatcacaagaagcttctgcgcacaactactggcaaatgcacaagctgccgcggctgccgaaaacaacaagaaacaagctgtagttaacgtgaatggagcgccgtccattcttgatgtacctggagcaggcaaaagagccgagcctgcggcggcggcggcggcggcggtggcaaaagctgctcaaaagaaagtcgttaaaccgaaacaaaaggctgaagttatcgatttaacgtcggattcggaaagagcgatcgaggccaagaagaagcaacaacatcatgagcctacgaagaaggaaggagagaaatcatcgagaaggaatatgcccactctcacttcggtcctcactgctcgaagcaaggcagcttgtgggatgactaaaaaacccaaagagaaggtcgtcgacatcgacgcgggtgacgcccacaacgagttggctgcattcgaatatatcgaagacatctacacttactacaaggaggctgagaatgagagcctgccccgtaactacatgtcgtcccagccggagataaacgagaagatgagggcgatcctggtggactggctgatcgagatccacaacaagttcgacctcatgcccgagaccctctacctcaccatcaacatcatcgaccggttcctctcggtgaaggcagtcccgaggcgggagctccagctgctgggcatgggcgctctcttcaccgcctccaagtacgaagagatctgggctcccgaggtgaacgatctggtgtgcatcgcggacagagcctacagccatgagcaagtgctggcgatggagaagacgatcctggggaagctggagtggacgctcaccgtacccacccactacgtcttcctcgttcgattcatcaaggcgtcgctcggcgatcgcaaattggagaacatggtgtacttcctggccgagctcggggtgatgaactacgcgacgctcacgtactgcccctccatggtggcggcctcggcggtgtacgcggcgcggtgcactctcggcctaaccccgctatggaacgacaccctcaagcttcacaccggcttctccgaatcccagctcatggactgcgcgaggctgctggtgggataccacgcgaaggcgaaagagaacaagctgcaggtggtgtacaagaagtactcgagttctcagagagaaggcgtggccctgatcccgccggccaaggctctgctttgcgaaggcggtggtctgtcgtcttcttcgtcgttggcgtcctcttcttgacgaaaggctctgctataactacaagagagagaggagagacgagtgcacacagcttttgagtttgttctcggccagagaaaaatgacagattgatatcgatgatgatgactgtcgtgtcatcagtagtgtgctttttttttacagtcacggattggtgacttttgttgttgactggaattcttctcctttcacttgtttgaagattcgtttaattcgttgaaggaaacattggctgctgtaaaaaaaaaaaaaaa

SEQ ID NO: 20 - DNA, 1824 bp, Eucalyptus sp.
ctctctctctctctctctctctcctgctcgtaagatcaaaggaggtcgacgacgctctctctctctctctctaggtctctgggtggcggtgggtgttcgggagggagagagaagggggagaggtagagggggagagagaagggagagattgtgttctgaggagtttattgttcttcttaccagataagtgaggcaaaacgaaaaatgggtttgcctgatgagaacaatgctgcactgagcaaacccacgaatctccaagttggagggttggagatcggaggcaggaaattcgggcaggagattaggcagaccaggagggcgttgagcgtgattaaccagaatttagttggagatcgtgcttacccatgtcatgtcgtcaacaagagaggccactccaaaagagatgcagtgtgcgggaaggatcaggtggatccagttcacagaccacttacaaggaagttcgcagcgcaaacggcgagcacgcagcaacattgcatcgaggaagcaaagaagccaagaacggcagttcaagagagaaatgaatttggagactgcatatttgtggacgtggaggactgccaaccatcttcagaaaatcaaccagtccctatgtttctggaaatcccagaatcaagattggatgatgacatggaggaagtggaaatggaagatatagtggaggaggaagaggaagagccaattatggacatcgatggtcgagataagaagaacccacttgcagtggttgactacattgaagacatttatgctaactataggagaacggagaattgtagctgcgtctctgctaactacatggcacaacaagctgacattaatgagaagatgaggtccatcctcattgactggcttatagaggtgcacgacaaattcgatctcatgcacgagactttgttcctcacggtcaatctcatagacagattcttggctcggcaatctgtcgtgagaaagaagctccagttggtggggttggtggccatgttattagcatgcaagtatgaagaagtctctgttcctgttgtaggagacttgattctaatatcggacaaggcttacaccagaaaggaagttcttgaaatggaaagtttgatgctcaactcgttgcagttcaacatgtcagtgcctactccgtatgttttcatgcgacggtttctcaaggctgctgaatctgataaaaagcttgaggtgctatccttcttcttgattgagctctcactggtggagtacgagatggtcaagttcccgccatctcttctagccgccgctgcgatctttacagctcagtgcaccctctatggtttcaaacagtggaccaagacttgtgaatggcacagcaactacacagaagaccagctcctagaatgtgcaaggatgatggtaggtttccatcaaaaagctgcaacagggaagctcacaggagtacatagaaagtacggtacatcaaagttcggttacacatcaaaatgtgaacctgctaactttctattaggagagatgaagaatccatagcaggagctcagtgtacagctaacctttttttcactgagaaaaattgggtgaaaaataaatttttagcaacttgggttgcgcttgggaattggtaaaaaggagaaaattctctagatttaagcctaaccctcggttgttagtctcttacagccaattgtttcagatatctcatcattgtttgtgattgattgaacactagactaatgtttttcctttccaattgtagttcgtcttttattgtaacaataaattgatagatactgattcgaaataatatttctcataaaaaaaaaa

SEQ ID NO: 21 - DNA, 1777 bp, Eucalyptus sp.
gtaagatcaaaggaggtcgacgacgctctctctctctctctaggtctctgggtggcggtgggtgttcgggagggagagagaagggggagaggtagagggggagagagaagggagagattgtgttctgaggagtttattgttcttctcaccagataagtgaggcaaaacgaaaaatgggtttgcctgatgagaacaatgctgcactgagcaaacccacgaatctccaagttggagggttggagatcggaggcaggaaattcgggcaggagattaggcagaccaggagggcgttgagcgtgattaaccagaatttagttggagatcgtgcttacccatgtcatgtcgtcaacaagagaggccactccaaaagagatgcagtgtgcgggaaggatcaggtggatccagttcacagaccacttacaaggaagttcgcagcgcaaacggcgagcacgcagcaacattgcatcgaggaagcaaagaagccaagaacggcagttcaagagagaaatgaatttggagactgcatatttgtggacgtggaggactgccaaccatcttcagaaaatcaaccagtccctatgtttctggaaatcccagaatcaagattggatgatgacatggaggaagtggaaatggaagatatagtggaggaggaagaggaagagccaattatggacatcgatggtcgagataagaagaacccacttgcagtggttgactacattgaagacatttatgctaactataggagaacggagaattgtagctgcgtctctgctaactacatggcacaacaagctgacattaatgagaagatgaggtccatcctcattgactggcttatagaggtgcacgacaaattcgatctcatgcacgagactttgttcctcacggtcaatctcatagacagattcttggctcggcaatctgtcgtgagaaagaagctccagttggtggggttggtggccatgttattagcatgcaagtatgaagaagtctctgttcctgttgtaggagacttgattctaatatcggacaaagcttacaccagaaaagaagttcttgaaatggaaaagttgatgctcaactcgttgcagttcaacatgtcagtgcctactccgtatgttttcatgcgacggtttctcaaggctgctgaatctgataaaaagcttgaggtgctatccttcttcttgattgagctctcactggtggagtacgagatggtcaagttcccgccatctcttctagccgccgctgcgatctttacagctcagtgcaccctctatggtttcaaacagtggaccaagacttgtgaatggcacagcaactacacagaagaccagctcctagaatgtgcaaggatgatggtaggtttccatcaaaaagctgcaacagggaagctcacaggagtacatagaaagtacggtacatcaaagttcggttacacatcaaaatgtgaagctgctaactttctattaggagagatgaagaatccatagcaggagctcagtgtacagctaacctttttttcactgagaaaaattgggtgaaaaataaatttttagcaacttgggttgcgcttgggaattggtaaaaaggagaaaattctctagatttaagcctaaccctcggttgtgagtctcttacagccaattgtttcagatatctcatcattgtttgtgattgattgaacactagactaatgtttttcctttccaattgtagttcgtcttttattgtaacaataaattgatagatactgattcgaaaaaaaaaa

SEQ ID NO: 22 - DNA, 1633 bp, Eucalyptus sp.
gagacgttggctttctggcttaaaggctattctttgtgcacaatgacctgagggaggtctcgacagaccacttcttctccgccaaagaagaagatggcgatggtacagcgacaaggtcacgacccatcatcgccgcaggagcaagaagacggtccttcctccttcttgtccgacgatgctctctactgtgaagaaggcagattcgaagaagacgacggcggcggcggcggccaagttgacggaattccactcttcccctcacagccggcggatcgacagcaagactcgccgtgggcagacgaagacggcgaggagaaggaggaggaggaggcggagctgcagtcgctcttctccaaggagcgcggagcgaggccggagctcgcgaaagacgacgggggcgccgtcgcggcgcggcgggaggccgtggagtggatgctgatggtgaggggcgtctacgggttctcggcgctcacggcggtgctggccgtcgattacctcgaccggttcctcgccgggttccgcctgcagcgggacaacaggccgtggatgacgcagctggtggccgtcgcgtgcctcgccctggccgccaaggtggaggagaccgacgtccctctcctcgtagaactccaagaggtcggggacgcgaggtacgtgttcgaggcgaagacggtgcagcggatggagctcctggtgctgtcgacgctcgggtgggagatgcacccggtgacgccgctgtcgttcgtccaccacgtcgccaggaggctcggcgcgagcccccaccatggggagttcacccactgggcgttcctccgccgctgcgagcggctcctcgtcgccgccgtctccgatgcgagatcgctgaagcatctcccgtcggtcctggccgcggcggcgatgctgcgcgtcatcgaggaggtcgagccgtttcgttcctcggagtacaaggcccagctcttgagtgccctccacatgagccaggaaatggtggaagactgttgcagattcattctgggaatagcagagaccgcgggcgatgccgtgacctcgtccctcgacagcttcctgaagcgcaagcgtcgctgtggtcaccttagcccgaggagcccgagcggggtcatcgacgcctcgttcagctgcgacgacgagtcgaacgactcgtgggccaccgacccgccatccgatccggacgacaacgacgatctgaaccctctaccgaagaagagcaggtcgtcgtcgccgtcctcctccccctcctcggtgccagacaaggtgttggacttgcccttcatgaacaggatctttgagggcatcgtcaacggcagtcctatctgatcgtccccctctctctctctctctctctctctctctctctctctagaatttgtatcgacccttttcaattaaatcaaagtgaagaaaatgtgaagtgaaagatgagagctttgcgttgaagaaacgggaagggtctgcgcttacgtatgcatgtctttttttggcgctccctctcggtctcttcaatgatcttgaagtgtccctttcacttcagaatttgcttcatgtatgggacatggacaggagatatatatattatgtcaccattacaataaaaaattacaatttttcggaaaaaaaa

SEQ ID NO: 23 - DNA, 1793 bp, Eucalyptus sp.
agatggctccgagagcaggcccattcttggacctctctttcttctttatctacaccgtctccattgcccctctcatggagtaatgatcttgtcgttcatcgacccttcttcttctaagaagaagcagaagcagaagcagaagcagaagcaggaggaggaggagcagaaggaggagatggaggccagttatcaaccccaccaccatggtcatcttcgtcaacacgacccatcgagctctcaacaagaagagcaagtccctttcgacgccctttactgctcggaggagcactggggagaagaagacgaagaagagggattggcgagcgatgggctcttgtcggaagagagagatcacagattgctgagcccgcgagccttgctcgatcaggacctgctctgggaagacgaggagctggcctccctcttctccaaagaggagccgggcggcatgcgcttgaatctggagaacgacccgtctttggccgatgctcgccgcgaggccgtggagtggataatgagagtccacgcgcactacgcgttctccgctctcacggctctgctcgcggtgaactactgggataggttcacgtgcagcttcgccttgcaggaagacaagccgtggatgactcagctctccgccgtcgcttgcctctctctcgccgccaaagtggaggagacccaagtgcctcttctcatcgatttccaagtcgaggacagtagccccgtctttgaggcgaagaacatacagagaatggagctcctggtgctctcgtcgctcgaatggaagatgaatccagtgaccccgctatcgtttcttgattacatgacaaggagactagggctgacgggccatctgtgctgggagtttcttagaaggtgcgagaacgtcctcctctctgtaatctcagattgcagattcacgtgttatcttccttcagtgatagctgcttccacaatgctgcacgtaatcaatggcctaaagcctcgtctcgatgtcgaagaccaaacccagctcctgggaatcctagcaatgggcatggacaagatcgatgcttgctataagctcatcgacgacgaccacgcattgagaagccagagatattcccacaacaagcgcaagtttggatcggtccccgggagccccagaggagtaatggaattgtgcttcagctccgatggctccaacgattcttggtccgtggcggcctcggtatcgtcctccccggagcctcactccaagaagagcagagccggcgaggaagccgaagaccggcttctgcgggggctcgagggcgaggaagatgaccccgcgagcgcggatatcttcagcttccctcactagcgggcacttcatccgggtcctggttatcatactcttatatatgttggggaataacggttcatatgtttcatgtaatgcgcaagttaaattgccaaccatctctcggttccagcctaattccccagaacgattgaaaacacaccagatcggaaggttgcaagaaccattctcgactgggattgctgggttcctaggcttttgagatttggaatggagatggttggcattttatccggattataactttagggattatgaacaaaatgaagagaagaaatcgttgggaaggatcctgctgttcctgttgttccttttttccctgtacggtcccccctccttctttccctattttctgtatcgaagcacttctgcagcagttcagctataggtagtactttgaaataaaagagctcatcatgaagggtaagcatttttgtttcaaaaaaaaaaa

SEQ ID NO: 24 - DNA, 1348 bp, Eucalyptus sp.
tctctctctccctctctctctctctctccatcccacattcttgaaagagacacatcagaagcgcagacatgaatctgggcaccggctcgttctctttcctgctccatctataatgagcaaagccttcgctctcttctccgcagaagggcatggctctgcaggaggaggacacccgccgccactacccgaccgctcctccgttctcgcccgacggcctctactgcgaggacgagaccttcggtgaagatctggccgacaatgcctgcgaatacgccggcgggggagcccgggatggcctctgcgagataaaggacccgactttgcctccgtcgttgctcgggcaggacttgttttgggaagatggcgagctcgcctccctggtttcgagagagaccgggacgcacccctgctgggacgagctaatctctgatgggtcagtggcgcttgctcggaaggatgcggtcgggtggattttgagggtccatgggcattacgggttccgtccgttgactgctatgttggccgtgaactacttggacaggttctttttgagccggagttaccagagggacaggccttggataagccagctcgtagctgtggcttgtctctccgttgctgccaaagtggaggaaacccaagtgcctattctccttgacctgcaagtggctaatgcgaaatttgtgtttgaatcgaggacgattcagagaatggagctcttgctgatgtctacacttgattggagaatgaactcggtgactccgatttcgttctttgatcacatccttaggaggtttggcttgacgactaatttgcacaggcagtttttctggatgtgcgagcgtttacttctctcagtggttgcagatgtgaggcttgcaagttttcttccgtcagttgttgccacggctgcaatgttgtatgttaacaaggagatagaaccgtgtatatgcagtgaattcctggaccagttactgagcctgctcaagatcaatgaggaccgagtaaatgagtgctatgaactcattcttgaattgtcaatcgaccatcctgagatcctcaactacaagcacaagcgtaagaggggatcagtacccagtagccccagtggtgtgattgatacttctttcagctgtgacagttcgaatgattcgtggggtgtggcatcgtctgtttcttcttcactggagcctcggttcaagaggagcagattccaggatcaacagatgggcctgccatctgtgaatgtttcatccatgggtgtgcttaatagttcttattagtcttagcttattatctttgattggacatgctataaagcagtctttcccctgcttcaaaaaaaaaa

SEQ ID NO: 25 - DNA, 523 bp, Eucalyptus sp.
ggttcctcctcctcctcctctctccatttccgctctcgattcctctccttccgctaaaccccgcagcttcggaattcccgctcgggttttcgctgagaagatgggccagatccagtactccgagaagtacttcgacgacacctacgagtacaggcatgtggttctccctcctgatgtggccaagcttctcccgaagaaccgcctcctttctgaaaatgaatggcgtgccattggagtgcagcagagtcgtggttgggttcactatgcaattcatcgccctgaaccacacataatgctattcaggaggcctctgaattaccagcagcagcaagagaaccaggcccagcaaaacatgcttgctaagtagacatgttatatttctaatgctttgagaacaatattacagtataattagggttggaagctttagtaaatgttaggatgttttgaaacttgtcattgtaattggcagcaattctcctctttggagaatctatcgtgggactttgtttaaaaaaaaaaa

SEQ ID NO: 26 - DNA, 1587 bp, Eucalyptus sp.
ccagatccatgggttcgattgacccgccaaaagccgaacagaacggcaccgcggccgccgccgtcgccgatcccggccagaagcccggcgccggagacgccatgccgccgccgccgcccgtcaagcactccaacgggaccgcggcggagcccgatgttgcgacgaagaggaggaggatgagcgtgcttcccctcgaggtgggcacgcgcgtgatgtgccgctggcgagacggcaagtatcaccccgtgaaggtcatcgagcggcggaagctgaatcccggagatcctaacgactacgagtactatgttcattacacggaattcaaccggaggctcgatgaatgggtgaaacttgaacagcttgatctgaattctgtagagactgtggtcgatgaaaaagtggaggacaaggtgacggggttaaaaatgacacgtcaccaaaagcggaagattgatgagactcatgtcgaggggcatgaggagcttgatgctgccagcttgcgtgaacatgaagaattcaccaaagtgaagaatatcgcaaccatagagcttggaagatacgagatcgagacatggtacttctccccctttccaccagaatacaatgattgttcgaagctctacttttgtgagttttgcctcaattttatgaagcgcaaggaacagcttcaaaggcacatgaagaagtgtgatcttaaacatccccctggagatgagatatacaggagcggtacattgtcaatgtttgaggttgatggcaagaagaataaggtttacgggcagaatctttgctatttggcaaaactctttctagatcacaagaccctgtattatgatgtagatctttttctattttatgtcttgtgcgaatgtgatgatcgaggttgccacatggttggatatttctccaaggaaaagcattccgaggaatcctacaatttggcttgcatcctcacactcccaccatatcagaggaaaggctatggaaagttcttaatagctttttcatatgaactttccaaaaaagaaggaaaagtcggcacgccagagaggcctctgtctgatcttgggctgttgagctacaaaggatactggacaagggttctgttggacattttgaaaaagcataaagcaaatatttctatcaaggagctcagtgacatgacagcaataaaggctgatgatattttgaacacccttcagagcctagacttaattcagtatagaaaagggcagcacgtcatatgtgcagacccgaaagtcttggatcgtcatctgaaagctgctggacgaggtggcctagaggttgacgtcagcaaactgatctggactccatacagagagcaaggttgatattaactggcaagttaggataggcatttcctttggcttgtatcattacacagtttgtacaaaatgcacagcttgtagtatctcaggcggaataagcctatgtttctaaagtcgctgacctcacggtccaatactttggcctttgatttggtagttttgtggaaaatcatcgactagaccgatggtcaaagtggtaatcatgtaattaaacgcgtttgtcattgctcggcaggaa

SEQ ID NO: 27 - DNA, 1787 bp, Eucalyptus sp.
cgcacgaggctctctctctctctctctctctctgcgcgcaatttcccgcctttcctcctcccatttcccgctcggagaaaccctaacgatggcgcagaagcacagcaccgcccccgatccggcggccgaacccaagaagcggcggcgcgtcggcttctccggcatcgatgctggagtcgacccgaacggctgcttcaaagtgtacctcgtgtccagggaagaagaagtgggggctccggatagcttctgccttgatccagttgacttaagtcacttctttgaggaggaagatggaaaaatctatggatatgaaggattgaagatatccgtctgggtaagctgtgtatcatttcattcatatgcagagattgcctttgagagcaaatcggatggaggaaaaggaatcacagatctgaacactgctcttaagaatatgtttggtgaaactctcgtggataataaagatgacttccttcaaactttttccaaggagacccaatttattaggtctacagtttcagccggggagattttaaagcataaacactctgacgatcatgtcaacgattccgttagtaatctaaaagttggttctgatgtcgaggctgtgcgcatgctgatgggcgatatgacagcaggacacctgtatagtcggttggtccctcttgttctgcttcttgtagacggtagcagtcctattgatgtaacggattcaagttgggagctatatcttcttattcagaagacaagtgatcagcaaggcaattttcatgataggcttcttggttttgctgctgtatatcgtttctatcactatcctgatagttcgcgactgcggcttggtcagattctagtattaccactttaccagcgcaaaggctatggccgctatctcctggaggtgcttaacaatgtcgcaatagctgatgatgtttatgacttcacaatagaagagccagtggataatcttcaacacttgcgaacatgtatcgatgtgcaacggcttctgagctttgacaaagtccagcaggcagtaaattcaacagtatctcagttgaagcaaggcaaactatcaaagaaaacctacatccctcggttgttgcctcctcctagtgtggttgaggatgccaggaagcgtttcaaaatcaacaagaagcagtttcttcaatgttgggagattctagtctatcttgggcttgatcccgccgataagagcatacaggattatttttccgtcatttcaaaccgtgtcagggcagacattttaggaaaagactctgagactgccggaaagaaagtgattgaagtaccgagtgattttgatccagagatgtccttcgtcatgcatagggcaaaagcaggcggtgaagctaatggtatccaagtggaggacaaccagaacaagcaagaagagcagctgcagcagttaatcgatgaaagattgaaggacatcaagctgatcgctgagaaggtaactcagaaatgatcacagaaaaaaggtcatgtaatacaaatgttgtagcccttggaatggaattaacagaggtcctgtagattgactgaggtgggcattgcccttttagcttatgatttgagaaacccttgcaggctgcgattagcggatcatgagagcatagttttgcttatgctcaatccctagttttgggtccaatttcattagaggtagatcatttcctgtttttataaccttcgtgtaagttagggaaggagctgcggtcgcggtcctggcattttcaagcgcctgtctctcggttcaaaaaaaaaaa

SEQ ID NO: 28 - DNA, 1778 bp, Eucalyptus sp.
ctcttcctccctccctctctctctgcgcgcaatttcccgcctttcctcctcccatttcccgctcggagaaaccctaacgatggcgcagaagcacagcaccgcccccgatccggcggccgagcccaagaagcggcggcgcgtcggcttctccggcatcgatgctggagtcgacccgaacggctgcttcaaagtgtacctcgtgtccagggaagaggaagtgggggctccagatagcttctgccttgatccagttgacttaagtcacttctttgaggaggaagatggaaaaatctatggatacgaaggattgaagatatccgtctgggtaagctgtgtatcatttcattcatatgcagagattgcctttgagagcaaatcggatggaggaaaaggaatcacagatctgaacactgctcttaagaatatgtttggtgaaactctcgtggataataaagatgacttccttcaaactttttccaaggagacccaatttattaggtctacagtttcagctggggagattttaaagcataaacactctgacggtcatgtcaacgattctgttagtaatctaaaagttggttctgatgtcgaggctgtgcgcatgctgatgggcgatatgacagcaggacacctgtatagtcggttggtccctcttgttctgcttcttgtagacggtagcaatcctattgatgtaacggattcaagttgggagctatatcttcttattcagaagacaagtgatcagcaaggcaattttcatgataggcttcttggttttgctgctgtatatcgtttctatcactatcctgatagtttgcgactgcggcttggtcagatcctagtattaccactttaccagcgcaaaggctatggccactatctcctggaggtgcttaacaatgtcgctatagctgatgatgtttatgacttcacaatagaagagccagtggataatcttcaacacttgcgaacatgtatcgatgtgcaacggcttctgagctttgacaaagtccagcaggcagtaaattcaacagtatctcagttgaagcaaggcaaactatcaaagaaaacctacatccctcggttgttgcctcctcctagtgtggttgaggatgccaggaagcgtttcaaaatcaacaagaaacagtttcttcaatgttgggagattctagtctatcttggtcttgatccagccgataagagcatacaggattatttttccgtcatttcaaaccgtgtcagggcggacattttaggaaaagactctgagactgccgggaagaaagtgattgaagtgccgagtgattttgatccagagatgtcgttcgtcttgcatagggcaaaagcaggtggcgaaactaatggtatccaagtggaggacaaccagaacaagcaagaagagcagctgcagcagttaatcgatgaaagattgaaggacatcaagctgatcgctcagaaggtatctcggaaatgatcacagaaaaaaggtcatgtaatacaaatgttgtagcccttggaatggaattaccagaggtcctgtagattgactgaggtgggcattgcccttttagcttatgatttgagaaaacccttgcaggctgcgatttgcggatcatgacagcatagttttgcttatgctcaatccctagttttgggtccaatttcattagaggtagatcatttcctgtttttataaccttcgtgtaagttagggaaggtgctgcattcgcggtcctggcattttcaagtgcctatctcttggttcaaaaaaaaaa

SEQ ID NO: 29 - DNA, 1346 bp, Eucalyptus sp.
caacgagcgaaaatcgctataaattccctcctaaaccctcgcctcacccttcgtccctgaaccctcgatctctctctagctagcttttggcgcccggcagagcttcctctcctcccctcgcctcgactcgcctcctctcttcgagctagaaagctctcgatggcccttccgatggagttctggggagttgaagtgaaggctggacagccccttaaagtcaaccctggcaatgctaaaatcttgcatctttctcaggcatcacttggtgaatgcaagagtagcaaaggaaatgaatcagtgcctctccatgtgaagtttggcgatcagaagcttgttttaggaactctctccacggagaacttccctcaattagcattcgacttggtttttgagaaagagtttgaactatctcacaactggaaaagtggaagtgtctacttttgtggatacaagtctgtcgtacatgatgatgatgatgaattttctgatttggagagtgattcagaagaggaagatcttccgatgattggtgtggaaaatggaaaggttgcagcacaagcatcagctaagactgctactgccagtgctaatgctagcaaggttgaatcatcgggaaagcaaaaggcccgcattccacaaccaatgaaagttgatgaggatgacagtgatgaggatgatgacgacgaagatgaagatgaatctgatgaggagggagttgatggtgaggctgattctgatgaggaggaagatgaaagtgatgaggaagagactccaaagaaggctgaaataggcaagaagagagctgcggattctgcaactaagacacctgtccctgccaagaagtcaaagttacctactccacagaagacagatggtaagaaaggtggccatacagcaactcctcaccctgcaaaacaggctggaaagaatcctgccaacagtgccaacaagtcgcaaagccccaaatcagctggccaagtctcttgcaaatcatgtagcaagacgttcaattcagacggtgctcttcagtctcattcaaaggctaagcatggtggcaagtaaattaaagaaccaagataaccatccggaaatagtcggatgttttttgttcgtcatcttctgtccccccaaaagtagtgtttgaggtgtatctcggtggaggttttgttgtgagggcttggtaggttttcattctattgtaatgtcggcgacggagattttggatggggattctttattctaatcagcagtaattagtcattgggttgtcaacttttccctctttccttcacttggtcgtggtacattttgcatgtattgtgatggatttttgactaaaaaaaaaa

SEQ ID NO: 30 - DNA, 1388 bp, Eucalyptus sp.
cctagctcgttccccgccctggcaacgagcgaaaatcgctataaattccctcctaaaccctcgcctcgctcttcctccctgaaccctcgatctctctctagctagcttttggcgcccggcagagcttcctctcctcgcctcgcctcctctcttcgagctagaaagctctcgatggcccttccgatggagttctggggagttgaagtgaaggctggacagccccttaaagtcaaccctggcaatgctaaaatcttgcatctttctcaggcatcacttggcgaatgcaagagtagcaaaggaaatgaatcagtgcctctccatgtgaagtttggcgatcagaagcttgttttaggaactctctccacggagaacttccctcaattagcattcgacttggtttttgagaaagagtttgaactatctcacaactggaaaagtggaagtgtctacttttgtggatacaagtctgtcgtacatgatgatgatgatgaattttctgatttggagagtgattcagaagaggaagatcttccgatgattggtgtggaaaatggaaaggttgcagcacaagcatcagctaagactgctactgccagtgctaatgctagcaaggttgaatcatcgggaaagcaaaaggccagcattccacaaccaatgaaagttgatgaggatgacagtgatgaggatgatgatgaggacgatgacgacgaagatgaatctgatgagggagttgatggtgaggctgattctgatgaggaggaagatgaaagtgatgaggaagagactccaaagaaggctgaaataggcaagaagagagctgcggattctgcaactaagacacctgtccctgccaagaagtcaaagttacctactccacagaagacagatggtaagaaaggtggccatacagcaactcctcaccctgcaaaacaggctggaaagaatcctgccaacagtgccaacaagtcgcaaagccccaaatcagctggccaagtctcttgcaaatcatgtagcaagacgttcaattcagacggtgctcttcagtctcattcaaaggctaagcatggtggcaagtaaattaaagaaccaagataaccatccggaaatagtcggatgttttttgttcgtcatcttctgtccccccaaaagtagtgtttgaggtgtatctcggaggaggttttgttgtgagggcttggtaggttttcattatattgtaatgtcgacgacagagattttggatggggattctttattctaatcagcagtaattagtcattgggttgtcaacttttccctctttccttcacttggtcgtggtacattttgcatgtattgtgatggatttttgactaaaaaaaaaaaaaaaaaaaaaaaaaaaaaaaaaaaaa

SEQ ID NO: 31 - DNA, 1215 bp, Eucalyptus sp.
gaaaattcatcgtcttccagaaaattcaccgcacagtcccctctcgagcttctccgccgtcagcaatggagttctggggtgtggaagtcaaaagtggggaacccctcaatgtcgaacccggggctgaaacagttgtgcatttgtcacaggcctgtctcggagaaaccaaggaaaaaacaaaggaatctgtacttctgtatgtccatattggggttcagaaactcgtccttggaactctctctgctgataagtttccccagataccttttgatctggtgtttgagaaaagttttaagctttctcataattggaaaaatggaagcgtcttcttcagtggatataagacgctacttccatgtggatccgacgctgacagtccatattctgactccgacactgatgagggtcttccaattaatgttactgctcaagctgacgtacctgcgaaaaaagcaccagtgactgctaatgccaatgcagcaaagcccaacctggcttctgctaagcaaaaggtaaagattgttgaatcaaatgaggatgggaaaaatgaaggggacgatgatgaagatgctgatgtatcttcggatgatgatgctgaggatgattctggtgatgaggacatggtcgatggaggtgatgaaagtagcgatgaagatgatgatgacagtgaggaaggggaaagttctgaagaggaagagcctaaggctcaaccaagtaagaagagacctgctgattctgtactgaaaacccctgcgtcagataagaaatcaaaactggaaactcctcaaaagactgatggcaagaaggccagtgagcatgtagcaactccatacccttctaagcaagctgggaaggcgattgccagtaaaggtcaagctaagcaacaaacaccaaactccaacgagttctcgtgcaaaccttgcaaccggtcatttaagtcggatcaggctcttcaatcacacaacaaagcgaagcatggtggaagctaaaactttgggaagtccaaagacactggcgattttgtccgacggaggtgggtgatgccaatcgaagagagctctgcaaccaggatgttcttttattattagttgtggcttttcatgactccattctggaacgaactatgggtcttaacgatctgtaacggcttaaaacttttgaagttgaaatactcgtgtccttcagttagctgttcgcattttgagcccaaaaaaa

SEQ ID NO: 32 - DNA, 1795 bp, Eucalyptus sp.
gcgacgagcgagggagaggggaagagaaggagagagagagtccgtgaaaagcttcaaaaatcattactttgggcggagacatctcacacaggaaacagaagtgacgagtgatggatactggagggaattctctcccgtctgggcctgatggggtgaagcggaaggtgtgctacttctatgaccctgaagtcggcaattactacttgctccagcatatgcaggtcctcaagcccgtccccgcgagagatagggatctctgccgcttccatgccgacgattacgtcgcctttcttaggagtataacccccgagacgcagcaggatcagctgaggcagctcaagaggttcaatgttggagaggattgtcctgtgttcgatggccttcactctttctgtcagacttatgccggaggctcggttggcggtgccgtgaagttgaatcacggtctctgcgatatcgctatcaactgggcaggtgggctgcatcatgctaagaagtgcgaggcttctggattttgctatgtcaatgacatcgtgcttggcatattggagctccttaaacagcatgagcgcgttttgtatgtggatattgatattcaccatggggacggtgttgaagaggctttctacacaactgatagggtcatgaccgtttcatttcacaaatttggtgattactttcccggtactggcgatatacgtgacataggatatggcaaagggaaatattactccctcaatgttccattggatgatgggattgacgacgaaagctaccattctctattcaaaccaataattggaaaagtaatggaagtgttcaaacccggtgctgtggtccttcaatgtggcgctgactctttgtcaggagaccgattaggatgcttcaatctatcaatcaaaggacatgcagaatgtgtcagatacatgagatcattcaatgtgccagtgttgctgctaggaggcggtggttacaccattcgtaatgttgctcgttgctggtgctatgagactggagtggcccttggacttgaagttgatgataagatgccacaacatgagtattatgaatacttcggtcctgactatacacttcatgttgctccgagtaacatggaaaacaaaaattcgcgacaattgcttgaggagataagatcgaagcttctcgaaaatctctctaagctccagcatgcacccagtgtcccattccaggaaagaccccctgatactgagctcccagaggctgatgaagatcaagaagatccggatgaaagatgggatccagactctgacatggatgttgacgaagatcgcaagcccctgcctagcagagtaaagagagaactaatagtagaacctgaggtcaaagaccaggattcccagaaagcatctatagatcatggaagagggcttgacacaacacaggaggataatgcatctataaaggtctctgatatgaattctatgataacagatgaacagagcgtgaaaatggagcaagacaatgtgaacaaaccatctgagcaaatattccctaaatagattgtccattgttggtaattgacttgtaatgcttctgtggcaaattcttaaagcttatgatgtcaaaacgtagctcttttttgtgtgaactatcctgctaaattaaacctcagcaaatactgcttccttgttttatagatccagacatttcgattttgtgtaaagttgacagttaagctattgaactcccagtacggttcgttagattttaaactgatcaatgaaatcttcatagttttatgataaaaaaaaaa

SEQ ID NO: 33 - DNA, 1753 bp, Eucalyptus sp.
gcgagcgagggagagggggagagggggagagagagagtccgtgaaaagcttcaaaaatcattactttgggcggagacatctcacacagaatccgaggaaacagaagtgacgagtgatggatactggagggaattctctcccgtctgggcctgatggggtgaagcggaaggtgtgctacttctatgacccggaagtcggcaattactactacggccaagggcatccgatgaagccgcatagaatccgcatgacgcacgccctgctggcgcactatggcttgctccagcatatgcaggtcctcaagcccgtccccgcgagagatagggatctctgccgcttccatgccgacgattacgtcgcctttcttaggagtataacccccgagacgcagcaggatcagctgaggcagctcaagaggttcaatgttggagaggattgtcctgtgttcgatggccttcactctttctgtcagacttatgccggaggctcggttggcggtgccgtgaagttgaatcacggtctctgcgatatcgctatcaactgggcaggtgggctgcatcatgctaagaagtgcgaggcttctggattttgctatgtcaatgacatcgtgcttggcatattggagctccttaaacagcatgagcgcgttttgtatgtggatattgatattcaccatggggacggtgttgaagaggctttctacacaactgatagggtcatgaccgtttcatttcacaaatttggtgattactttcctggtactggcgatatacgtgacataggatatggcaaagggaaatattactccctcaatgttccattggatgatgggattgacgacgaaagctaccattctctgttcaaaccaataattggaaaagtaatggaagtgttcaaacccggtgctgtggtccttcaatgtggcgctgactctctgtcaggagaccgattaggatgcttcaatctatcaatcaaaggacatgcagaatgtgtcagatacatgagatcattcaatgtgccagtgttgctgctaggaggcggtggttacaccattcgtaatgttgctcgttgctggtgctatgagactggagtggcccttggacttgaagttgatgataagatgccacaacatgagtattatgaatacttcggtcctgactatacacttcatgttgctccgagtaacatggaaaacaaaaattcgcgacaattgcttgaggatataagatcgaagcttctcgaaaatctctctaagctccagcatgcacccagtgtcccattccaggaaagaccccctgatactgagctcccagaggctgatgaagatcaagaagatccggatgaaagatgggatccagactctgacatggatgttgacgaagatcgcaagcccctgcctagcagagtaaagagagaactaatagtagaacctgaggtcaaagaccaggattcccagaaagcatctatagatcatggaagagggcttgacacaacacaggaggataatgcatctataaaggtctctgatatgaattctatgataacagatgaacagagcgtgaaaatggagcaagacaatgtgaacaaaccatctgagcaaatattccctaaatagattgtccattgttggtaattgacttgtaatatgcttctgtggcaaattcttaaagcttatgatgtcaaaacgtagctcttttttgtgtgaactatcatgctaaattaaacctcagcaaatactgcttcaaaaaaaaaa

SEQ ID NO: 34 - DNA, 1617 bp, Eucalyptus sp.
ggagaaggcaaggcaacccaccagccaagcggacggagagagggtctgctcctcctccttccgtcgcagcaccacagcaccttcacgccaatggtgcggcctcgctagcgatacaccgtctccgccgcttcgttcgcaggacgggaagctcaggatgcgacccaaggacaggatttcgtacttctacgacggagatgtgggcagcgtctatttcggtccgaatcatccgatgaagccgcaccggctctgcatgacccaccatcttgtcctctcttacgagcttcacacgaagatggaaatttaccggccgcacaaagcctaccccgctgagctcgcccagttccactctcctgattatgtcgagtttttgcaccggattacacccgacacccagcacctgttcccaaatgatttggcaaaatataatcttggagaagattgtcctgtctttgaaaacttgttcgagttttgtcaaatttatgctggtggcacgatagatgctgcaagaagattaaataatcaactctgtgatatagctatcaactgggctggaggattacatcatgccaagaagtgtgaagcatctggattctgctatataaatgacctagttttgggaatattggagctgctgaaatatcatgcacgtgttttatatattgacatagatgtgcatcatggtgatggcgtagaagaagccttttacttcactgacagggtaatgactgttagctttcacaaattcggggatatgttctttccaggaactggtgatgttaaggaaataggaggaaaagaaggaaagttctatgctatcaatgtcccactcaaggacggaatagacgatactagcttcactcgacttttcaaggctatcatttcgaaggtcgtcgaaacataccaacctggtgctattgtactccaatgcggagcagattcacttgctggggaccgtttggggtgtttcaatctctctattgatggacattctgagtgtgtaaggttcgtcaagaaattcaatttgccattattggttactggtggtggaggatacacaaaagagaatgttgctcgatgttgggttgttgaaacaggagttctcttagatacagaacttccaaatgagattcctgaaaacgagtatttcaagtactttgctcctgattattcattgaagattcctcgtggaaatatcgtactcgagaatctaaatagcaagtcctacctcagtgcaatcaaagtgcaagtgttagaaaaccttcgtaatattcaacatgccccaagtgtacaaatgcaggaggttccacccgatttctatattcccgattttgacgaagacgagcagaatcctgatgaacgaatggatcagcatacccaggacaagcaaatccaacgagatgatgaatattatgatggggacaatgataacgaccataacatggatgattcatgatgccaagctaagcaatatgtaattttttttttaaggatacgacatttgaattggcgatcacaatctactgtagtcaatactcaagtgggaggtgtaaatagattccatctgaattttgtgaagcagatattagttcctacttttgtgaaaaaaaaaaaaaaaaa

SEQ ID NO: 35 - DNA, 2507 bp, Eucalyptus sp.
ggcaccaaacatcgaggcacaacagcatcgtcccccgcgtctccgtcgcgacaccctcctcgtccggtggcggtggtggcggtgcggagtttaaaagcgtcgcggtttccctcgacacgaccgagcctcccccacaacctcactcgcccgctcgctcgcgatcgacggcgcgcgctcgccggcttccgccttcctctccggcgatctcggcatgatgtattaaaggaatgacagtggctgaagatttccatgtaaacaacaggtctaaaatggtttcccaggcaactccagaaagtcgtctcacaggtggagaagatgataacagtctgcacaatcaagttgatgagctcctctgtcaggaattaccagaaagacaagtgatattggagtttgaaggcaccaggcctaagccttatttcagtgatcataacgggggagaaaatagtgcattaggtgtgagagccaccgaagatgatttgaattctgatgtggaggctgaagaaaagcagaaagaaatgactttagaagatatgtacaaaaatgatggcaccttatatgatgacgatgaggatgacagtgattgggaaccggtgaaaaggcaagtggaactgatgaggtggttttgcaccaactgtacaatggtgaacgttgaagatgtctttctctgcgatatatgtggggaacatagagattcaggtatcttgagacatggcttttatgcatctccattcatgcaagatgtgggtgctcctagcgttgaagcagaagtacaggaatcacgtgaagatcatgctagaagttctccgccaagcagttcaactgttgtgggttttgatgagaagatgctgctacactcagaggtggagatgaagtcacatcctcaccctgaaagggcagaccgtcttcaagctattgctgctagccttgctactgccggcatatttcctggaagatgccgttcgcttcctgtgagagaaattacaaaagaagagctgcagatggtccattcttcagagcatgttgatgctgttgaaatgacaagccatatgttttctagctactttactcctgacacatacgcgaatgaacattcagcgcgtgctgctaggattgcagccggtttgtgtgctgatctcgcttcaacaattatttctggacgttcgaagaatggttttgctctggttcgtcctcctggtcatcatgctggtatcaaacatgccatggggttctgcctccacaataatgcagcagttgctgcactagcagcacaaggtgcgggggcgaagaaagtgcttatagttgactgggatgttcaccatggaaatggcacgcaagagatttttgatggaaataaatcggtcttatacatatcactacatcgacatgaaggaggaaacttttatcccggtacaggtgctgcccacgaggtcggtaccatgggtgctgaaggatactgtgtgaatattccatggagccgtcgaggagtcggtgacaatgattatgtttttgcatttcatcatatagtgcttcctatagcttccgcatttgctcctgatttcaccatcatatcagctggatttgatgctgcgaggggtgatcccctagggtgctgtgatgtcactccggctggctacgcacagatgacacacatgttgagtgctctttctggtgggaagctgcttgtcattctagagggaggttacaatcttcgctcaatctcctcttctgctgtggcagttattaaggtgttactgggtgactcacctatatctgaaattgcggatgcggtgccctcgaaagctggcttgcgtactgtgttggaagtcctgaagatacaaaggagctactggcctagtcttgaatccattttttgggaattgcagtcacaatggggaatgtttcttgttgataacagaagaaaacagatcagaaagagacgacgggtgttggtgccaatatggtggaaatggggtcggaaaagtgtgttgtatcatctcctaaacggtcatcttcatgtgaaaacgaagcggtgaatgtctaggctctagtctgtgtattcttcctttgtgcaactttgtataccatcagctggcagtcctcttttatccgtggaagactctcatggtgattttgacaaccatttttacattgtaaatctaggttaaccatcattagagtagagctccttctgatctactactgttaagagaggagtggtcagcggccttcattttatgtttaaatgttcaaatgttgataattgcaacttttttgggagcttgcttttgcattaagctcggattggatcgagaagcatgccgattttgttggggcagtcagatgtatgtgatcatgtgtaatcagtatatcaggttagaaacagtactcttgagcttagcgggcactgttcttcgctgcttcagaggtttaagtcctcaaggtcagggaaaatgtttgtggtttcgcttctttgagttcataactgtctttttggctcaaaaaaaaaa

SEQ ID NO: 36 - DNA, 1409 bp, Eucalyptus sp.
acaggcaaaaagcataagctggcaagagcttcctcctgctgagttacagcatcctttaggatcagaagaggggaaacatcatcggctgcttcgctattcaactctcgaatggctgctgctccttcttctcctccgacgaaccgggtcgacgtgttctggcacgacgggatgctgagccacgacaccggtcggggcgtgttcgacacgggatccgacccgggcttcttggacgtgctcgagaagcacccggagaaccccgacagggtccggaacatggtctcgatcctcaagcgaggacccatctctcccttcatctcctggcacactgcaacgcctgctctcatctctcagctcctctcttttcactctccggaatacataaatgaactagtggaagctgataaaaacggagggaaagttctttgcgctggaactttcttgaacccagggtcatgggatgccgcgcttcttgctgctggtaacacactttctgctatgaaatacgtacttgatggtaaggggaagattgcatatgcactagtgaggccacctggtcaccatgctcagccttctcaagccgatggatattgcttcctaaacaatgccggtctagcagttcgattggcattggactctgggtgcaaaagggttgtcgttgttgatatagatgtgcactatggaaatggaacagcggagggattttaccaatccagtgacgttctcaccatctctcttcacatgaatcacgggtcctggggtccatctcatccacaaagtggatctgtcgatgagcttggtgaggatgaaggatacgggtataatatgaacattccgttgccaaatggaaccggagacaggggatacgagtatgctgtgactgagctggttgtgccagctgtggagagtttcaaacctgaaatggttgttcttgttgttggccaagactctagcgcgttcgatccaaatggaaggcagtgcttgacaatggatggatatcgggcgattggtcgaacaattcgtggcctcgcggataggcacagtggaggccgcattctcattgtccaagaaggtggatatcatgttacctactcagcttattgccttcatgccacggtggaaggcattcttgatcttccagatccattattagctgatccaattgcttattacccagaagatgaggcttttcctgtgaaggtggtcgactcaatcaaaaggtaccttgtagataaggtaccttttctcaaggaacattgatacagagatgttgcgatataactttgctttattggcacggtgtccccaaatctagtttgaatattttgtttttttaggacttcatctgagatagaagtagaagctaatatgaagaaagtagtgatttctatattttattttttgggtgagaa

SEQ ID NO: 37 - DNA, 1760 bp, Eucalyptus sp.
agcgagagcgagagagagagagagagagagagagaggcgcgcggcggagatggtcgagagcagcggcggcgcgtcgctgccgtcggtggggcaggacgcgcggaagcggcgcgtgagctacttctacgagccgacgatcggcgactactactacgggcaggggcacccgatgaagccccacaggatccggatggcgcacaacctcatcgtccactactacctccaccgccgcatggagatcagccgccccttccccgccgccaccaccgacatccgccgcttccactccgaggactacgtcaccttcatctcctccgtcacccccgagaccgtctccgacccggccttctcccgccaactcaagcgcttcaacgtcggcgaggactgccccgtcttcgacggcatcttcgggttctgccaggcctccgccggcggttccatgggcgccgccgtcaagctcaaccgcggcgactccgacatcgccctcaattgggccggcgggctgcatcacgccaagaagtccgaggcttctgggttttgctatgtcaacgatatcgtgcttgggattctcgagctcctcaaggtccacaagcgtgttctctacgtggatatcgatgttcaccatggggatggggtggaggaggcattttatacgacggatagagtcatgaccgtatctttccataagtttggggacttcttccctggaagcgggcacattaaggacaccggggcagggcctgggaagaactacgccctcaatgtgccactgaatgatggcatagatgatgaaagtttccgtggtatgtttcgccccattatccaaaaggttatggaagtatatcaaccggatgccgttgttcttcagtgtggggcagattcactgtctggagaccgattgggatgcttcaatttgtctgtgaaaggtcatgcagattgcctccgttttctaagatcttttaacgttcctttaatggtcttgggtgggggaggttatacaatgagaaatgtcgctcgttgctggtgttacgagacagctgttgcggtgggagtagaacctgaaaatgacttgccttacaatgagtattacgagtactttggcccagattatactcttcatgtcgagccatgtagcatggagaatcttaatgcaccaaaagatttggagagaatcaggaatatgttattagagcagctatcgagaatcccacatgcaccaagtgtaccttttcaaatgacaccgcccattacacaagagccagaagaggcagaggaagatatggatgaaaggccaaagccacgcatttggaatggtgaggattatgaatcggatgctgaagaagacaagagtcagcatagatcatcaaatgctgatgctttgcatgatgaaaatgttgaaatgagggacagtgttggtgaaaacagtggggacaaaacaagggaagatcgttctccatcttgacaaagatcagcaaagatcagctctaactcttgtgtacttttgggtctttctgatatgcgatgcatgtaattctttctaggccaggagataaccttatcaagccaatagagtctaatggttggccacactggatgattgctgatagacgaggcgggttatgtttatcaggtgtcacagtgcatgttggaataggaagactgaattgctgagtgtaaatgggatgttttcttatgtctccagctgatgtggtttgtttcattggctcatgtgagatggatttacttagttaaaaaaaaaa

SEQ ID NO: 38 - DNA, 1001 bp, Eucalyptus sp.
ctgcgcttcatttgccattcgttttctcctctgcctcgtttctttgcggttcggacgcatcatggatgtatctccaaagagtaatctgtcgattccgtggacaagatccacagctgcttcttgaggtcatgctatattggaaccagcttaaggtcagttgagaggacttcaaccaatggtagttcctagcagtaacccccacaacagggaaatggccattaggaggaggatggccagcacattcaataaaagagaagatgattttccatccttgagagagtacaatgactacttggaagaagtggaggaaatgacattcaatctgattgaaggagtggatgtgccgactattgaagcaaagattgcaaagtaccaggaagaaaatgctgagcagattatgattaatcgtgcgaaaaaggctgaagagtttgctgcggcattggctgcaagcaaggggctgcctcctcaaactgatccagatggggctcttaactctcaagcaggattgagtgttgggacacagggacaatacgctcctgcaattgctggaggacagccacggccaacaggcatggctccgcagccggtgccacttgggactggcctcgacatccatggatatgatgatgaagaaatgataaagctccgagctgaaagaggaggcagagcgggagggtggagcatagagctaagcaagaaaagggctcttgaagaagcatttggaagcctttggttataattcagttagttctagcactgtttgtgggtgggagcattctaagatggttcttaagggaggaagcgagaattgcaattgttatgattggtctgactaagaagtgtttgcaattatccgcgtgaagatcatgtctttctggttcttgcatggagagcatttggagcagcagcagcagccttgctgctctctggcaattttaatgtgacattgaaggtgtaaaactgttacctctaatacgatcatacttggaataaaaaaaaaa

SEQ ID NO: 39 - DNA, 1797 bp, Eucalyptus sp.
cttcctctcagaccgtcccagaagccttatcttcattggcttctctcagctcctgtaccaatttcgtgtctctcttgttttcttccgacacacccgtttcccatgtctttgtaacacctcgaaagctcttatcttctgcgctctctcccatggcagcaatcatatcctgccaccactaccactcctgctgctcctccctcatcgcctcgaagtgggttggcgccagaatacccacaagttgtttcggccgttcgagtacgcagagcaacaatgcggcgtcggtcaggcagttcgtcacccggtgttcttcaagcccgagcagtcgcggccaatggcagcctcaccagaacggagagaaagggagatcattttccttgagagaatgtgcgatatctattgctttggcggttggattggtgacgggagtgccttcgttggatatgtctacgggcaatgcttatgctgctagtcctgctctgcctgatctctctgtcctaatatctggcccaccgattaaagaccccgaggctttgctaagatatgctcttccgattaataataaagccataagggaagttcagaagccgctcgaggacatcacggatagtctcaaggttgcaggactcagagctcttgactccgtggagagaaatgtgaggcaagcatctcgggtgctcaagcaaggtaaaaatctgattgtatctggcttagctgagtcaaagaaggatcacggagtggagttgcttgacaagctggaagctggaatggatgagctccaacaaattgtggaggatggaaatagagatgctgtagcgggcaaacagagggaactgctaaactatgttggaggtgttgaagaggatatggtggatggcttcccttatgaagttcctgaggaatacaagaatatgcctctcttgaaaggtagggctgctgtggatatgaaggtcaaggtcaaggacaatcccaacctggaggagtgtgtgtttcgaatagtcttagatggttacaatgcacctgtgactgctgggaatttcgtggatttggtagagaggcacttctacgacggcatggaaatccagagagccgatggatttgttgttcagacaggtgatcccgaaggtcctgctgagagttttattgatcctagcacagagaaaccccggacgatacctttggagatcatggtggatggggagaaagcgccagtatatggagcaactcttgaagagcttggcctctacaaggctcaaacaaagcttccatttaatgcatttgggacaatggccatggccagagatgagtttgaggacaattccgcatcaagtcagatattttggctgctaaaggaaagtgaactgacccctagtaacgcgaatatattagatgggcggtatgcagttttcggttatgtgacagaaaatcaggatttcttagcagatcttaaggtcggtgatgtcatagagtcggtgcaagtcgtctcgggcctggataatctggcgaatcccagctacaagattgctggctagagttttccttttctctccgtttcccaatatcgttcgtttggacactgcacatgccagcttgtatgactccaacgtgtagttgtttaaggctaatgttcttcgtatgattcttgttatttatgagagataatgtgttgtccacattgagaatgtattcttttttgggattgcattgatatcaaattcagatctattagtgaaagttggcatgagtctcaatcttaggggaatacagtacggagaatgaatttctggatgaaaaaaaaaa

SEQ ID NO: 40 - DNA, 2337 bp, Eucalyptus sp.
ggtcatctctctctcttcctcgagacttcgccccccgcaaaacccttgcgctccgaactctctagaaccgcctccctctctccgcccttataaatctctccctctctccccccccccgccgcgcctccgctcgcttcccgacacccccacggagacgccatccccagctccgcttcgcgatccgtttgcagcctcgcggtcgtcggcagccgtccctctctctcgggcgagagacttccggcgaacatggccggcgaggacttcgacattccgcccgccgacgagatgaacgaggacttcgacctccccgacgacgacgacgacgcccccgtcatgaaggccggcgatgagaaggagatcggcaagcagggcctcaagaagaagctcgtcaaggaaggcgacgcctgggagactcccgataatggcgacgaagttgaagtgcattacaccgggacgctcctggatggtactcaattcgattctagccgggaccgcgggactcctttcaagttcactcttggccaagggcaagtgataaagggatgggatcaaggtatcaagacaatgaagaagggggaaaatgcaattttcaccatacctccagagctagcttatggcgaggctggctcacctccaactatacctcctaatgcaactctgcaatttgatgttgaactactttcttggacgagtgtcaaggatatttgcaaggatggtggtattttcaagaaaattctggtggaaggcgaaaaatgggaaaatcctaaagatctggacgaagtattagtcaagtatgagtttcagctggaagatggtaccaccattgcaaggtctgatggagtggaattcactgttaaagaaggacatttttgcccagcagttgctaaagctgtcaagacaatgaaaaagggagagaaagttcttttgactgtcaagccacaatatggatttggcgagaaaggtaagccagcttctggtgatgagggtgctgttccacctaatgccactcttcaaataacgttagagttggtatcgtggaagactgtgtctgaagtgaccgatgacaagaaagtaatcaaaaagattctcaaggaaggggaagggtatgagaggcctaacgaaggagctgtagttgaagtgaaattgattgggaagttgcaagatggcacggtattcgtgaagaagggccacgatgattgtgaggagttattcaagttcaagatcgacgaagaacaagtagtggacgggcttgacaaagctgtgatgaacatgaaaaagggagaggttgctttgctgactgttgcacctgagtatgcttttggatcttctgagtctaagcaggatctggctgtggtacctcctagttcgactgtgtattatgaggtggagttggtctcttttgtcaaggacaaggagtcgtgggacatgaatactgaggagaagattgaggctgcaggtaagaagaaagaagaaggaaatgttatatttaaggcagggaagtatgcgaaggcttccaaaagatatgaaaaggctgtgaagtacatagaatacgatacctcctttagtgaagatgagaagaaacaagcgaaggcactgaaagttgcttgcaatctgaatgatgcagcatgcaagctgaaactcaaagattacaatcaggctgagaaactatgcaccaaggttttggagctggatagcaggaatgtgaaggctctttatcggagggcgcaggcttacattgagctgtctgatcttgatttggctgaatttgacatcaagaaggcgctagagattgatcctcacaatagggatgtgaaactggagtataaagtattgaaggagaaggtcaaggagttcaacaaaaaggatgccaagttctatggcaatatgtttgccaaaatgagcaaactagaacctgttgagaagactgcagctaaggagcctgagcctatgagcatagacagcaaggcgtgagagagaagcacctaattccgtttcttttctttcggttcatttgggtccttctctacatgcaaggaattctctattccgcagcaatgtaactgggattattttatcggattgaaaaacatataatgtcggtacagtgtgtcgtgtggtttaggtcagttatgttgcggttggagttttcaaaagttcttgtaccattgaaaattctcttgcgcagtttggagaggttattgtctctcaatcgatctgtctgtttacttgtccagttgatatgagtatcataactcggatggtgacaactttgtactacggtcggcaccggtagatgatggtgcatatgggagacgaggtacggttataaaaaaaaaa

SEQ ID NO: 41 - DNA, 2397 bp, Eucalyptus sp.
gggaccggcggccgacggcgtcgttaggggtgttcttcttccccagccgagctccagaaagacctggaaatcgcgggcggcggaagattcgccttcgtcgagatcagcgcggggagctccggcttcgagtagaagatgtcgaccgtgtacgtgttggagccgccgacgaaggggaaggtggtgctgaacacgacgcacggcccgctcgacgtcgagctctggccgaaggaagcgcccaaggccgtacggaacttcgtccagctctgcctcgagggctactacgacaacaccatcttccaccgcatcatcaaggacttcctcgtccaaggcggcgatcccaccggctccggcacaggtggcgaaagtatttatggggatgcgttttctgatgagtttcattcacgtttgaggttcaagcacagaggtttagtggcttgtgccaatgcgggatcaccacactccaatgggagtcagttttttatcacattggatcgatgtgactggcttgaccggaaaaataccatttttggaaagataactggcgattccatatacaatcttagtggattagctgaggtcgaaactgacaagagtgatcgcccgttggatccacctcccaaaattatctcagtggaggtactctggaaccctttcgaagatattgttcctagagcaccagtgaggtctttggttccaactgtacctgatgttcaaaataaagaaccaaagaaaaaggccgtaaaaaagctgaacttactttcatttggagaggaagctgaagaggaggagaaggcattggttgttgttaaacagaagatcaagagcagtcacgatgtgcttgatgatcctcgcttgctgaaagaacatataccaagtaaacaagtggactcatatgacagcaaaaccgcaagggatgtccaatctgttagagaagctttaagctcaaagaaacaggagctgcagaaagagtccggagctgaattttcaaattcattcagggaaattgccgatgatgaagatgacgacgacgacgatgcgagctttgatgcaagaatgcgtagacaaatacttcagaaaagaaaggagctgggtgatctccctccaaagccaaagccaaagtcgcgtgatgggatttctgccagaaaggagcgggagacatctatttcaagggacaaagatgatgatgatgatgatgatcaaccaagggtggaaaagctctccttgaagaaaaaaggaataggatctgaagccagaggtgagcgaatggctaatgctgatgcagatttgcagctgttgaatgatgctgaacgaggtagacagttgcaaaaacagaaaaagcaccgccttcgaggacgtgaagatgaggtacttactaagctcgaaacgttcaaggcgtcagtatttggaaaacctttggcgtcaagtgccaaggttggagatggtgatggtgatttatctgactggagatcagtgaagttgaagtttgctcctgagcctggcaaggaccgaatgactcgtaatgaagacccaaatgattatgttgttgtggaccctctcttggagaagggaaaagagaaattcaacaggatgcaggccaaagaaaaacgaagaggacgggaatgggcgggcaaatctctcacttgatcctatttatccccatttgcatgtctcatgaatataacccactccgtgagccaccgggcgatggtgccaggttcatgcttgcagagccattcgaccaacaaactttggacaaactaaaccagcaattctagaagtgccatgttagagttggtagctctcttcattgaagagatcgacctgttgacatcctctttctgcatcactaggacacaaatcaacatgtacataagtctctcctttgagagaggcggatattctagtaggaccgttctcgaagtgggactgttcttgctgagagttttcttagttctttccttttgttttctctctcaacattatgttttgctggtctcatttcgaccgaagcgcttctggaagaaaacaatacggccggaagacttggaaaacaaggggagtgatctccgtctctgcccactaacgccgagcatgacaggaaggaaaggcgttggattctgaccaaccccaccacgatgttctcgattccttctagacgtttgacgatgggggctgactgcagacctgtccgagcctgctcataatttggttggctattcttgaaggagagccatcacatggtccttgttggctgtgtcgggtccattggagttttgatcgtcttgtgtcgtattagttgtcatcatcatgagaatttgggaatctgactcttctcattcttgaatcgcaacgatcaatttctatgcatagaagagagaattatttttaaaaaaaaaa

SEQ ID NO: 42 - DNA, 1061 bp, Eucalyptus sp.
ccggataaccgcgtcttatctgaaaccgccggtccaaaccaccatcaatggcgtccgcaatctccatgcacagctctggcctcctcctcctccagggtaccaacggtaaagatgttactgaaatgggtaaggcacctgcaagctctcgagttgctaatatgcagcaaaggaagtatggggcgacatgctgtgtggccagaggattaacatctagatctcactatgcctccagcttggcattcaaacaattttctaaaaccccctccatcaaatatgacaggatggttgagatcaaggctatggccacagacttggggctgcaggcgaaagtaacaaacaaatgcttctttgacgtggaaattggcggagagcctgctggtagaatagtaataggcctctttggagatgatgttccaaaaactgtcgagaacttccgtgctttatgcacaggtgaaaagggatttggctacaaaggatgctccttccatcgtatcattaaggattttatgatccagggaggggatttcactagaggaaatggaactggaggaaagagcatctacggttcaacttttgaagatgagaactttgcattgaagcatgtcggacctggagtactgagcatggctaacgctggccctagcactaatgggagccaatttttcatatgcactgtaaagactccatggttggacaatcgccacgttgtgtttggacaagtcgtcgacgggatggatgttgtgcagaaacttgaatctcaggagacaagtcgatcggacgtgcctcggcagccatgcagaattgtgaactgtggggaacttcccctagatggttgattcacatgagctggcttgttgcaatgcggagcacaaattttggtaatgtgttccggttttgtcatgtttcatgcgacagctcttcgttgtgtcagtattttttaactggatgttcatgtatgcttagagattccattggtgattctgacttcagtggtagcccatgaaatttgggttctgtgttagaattctttcgtcaaggaaagtgaattttcaaaaaaaaaa

SEQ ID NO: 43 - DNA, 1049 bp, Eucalyptus sp.
gggaaaaaggaaaaatatcttcgttctcttccctcttcatcgccttccatggcggcttctttcacagctctgtccaatgtcggctcgctttccagcccgaggaacggctcggagattagacggttccgcccctcctgcaacgtcgccgccagcgtccggccgcctccgttgaaggccggcttgtcggcgtcgtcctcgagctctttctccggctctctgcgcctgattcccctcagctcttctcctcagaggaaatcccgtccgtgctcggttcgagcaagtgctgaggctgcggccgctcagtcgaaagtcaccaacaaagtctaccttgacattagcatcggtaaccctgtcgggaaactagtcggaagaattgtgattggattatacggcgacgatgtcccgcaaacagcagagaatttccgcgcattatgcacaggagagaagggctttggatacaaaggttcaacggtccaccgtgtcatcaaagattttatgattcagggaggtgactttgacaaaggaaatggaacagggggtaaaagcatatatggccgtacttttaaagatgaaaactttaagttgtctcatgtcggacctggggtggtcagcatggcaaatgcagggcccaacaccaatggtagccagttctttatctgcactgtgaagacaccgtggctggaccagaggcatgttgtgtttgggcaagtgctggaaggcatggacattgtcaggctcattgagtcacaagaaacagaccgaggagaccgtcccaggaaaagagtggtcgtctctgactgcggtgaacttcccgtggtgtgatatgccttgattggttgggttctgcaagttagttctggctaaaatctgagtcatgctctccctcgaattttcttctttgttaatttctctgttttgttgagagagcaaactttgggaagagccaggtcgcgattggtaacgctcaactattgtagtgtaccgacggaattttccttaaattggaagcacagaatgactgctcctgagtctcttctttaaaaaaaaaa

SEQ ID NO: 44 - DNA, 1028 bp, Eucalyptus sp.
ggccgatcgctgtggctgatctcgtcgctccggttgtaaagcatgtcgagcacatcatctcctccttcttattcttcttcttggatcaaagcatgttcagcacatcatgacccaacagaagccctttggcttgcatctgtaactcagttcccctttccatacaagcaggcttttcataaaaatcatggctgaggcaatcgatttgacgggtgatggaggggtcatgaagacaattgtgcgacgagcaaaaccggatgcagtctctccttcagagacccttcctcttgttgatgttcgttatgaaggagtacttgctgaaactggtgaagtctttgactcaacacatgaagacaatactctattctcctttgagatcggaaagggctcggtgatcagtgcttgggacactgcattgagaactatgaaggttggggaggttgcaaaaatcacatgtaagccagaatatgcctatggcagcacgggttctccacccgatatcccaccagatgcaacccttatttttgaggtggagttagttgcatgcaaaccgtgcaagggcttttcagtgaccagtgtcacagaagacaaggctaggcttgaggagctgaagaagcaaagggagatagctgccgcaaccaaagaggaagagaagaagaggagggaagaagctaaagctgcagctgctgctcgtgttcaagccaagctggatgctaagaaaggtcacgggaagggaaagggaaaagcaaaatgaacagctttataaggaatactcaagtagatcataactcagttttccttcatatgccttttaaacttggctaggatcttaaccttgagtattatggaatataagttaagaccagacttcccatacttgatggtgtgcttggatatactgtataagcattctatattatgcttgttggcttcgttttgagggagcaaaactgactagaaaggagaaagtatgtagtacatcgactctgatgaatggcattttgattacggtagctttctcaaaaaaaaaa

SEQ ID NO: 45 - DNA, 936 bp, Eucalyptus sp.
ggaattcattgacgacgacaagttaacgtcgaccgcttctctgccccttgaattttcccgagaaaaccaggaacctgccaaatatctctctgaaagatctccatgggtaacccgaaggtgttcttcgacatgtcgatcggcggccagccggccggccggatcgtgatggagctctacgccgacgtggtgccgcgcacggcggagaacttccgcgcgctctgcaccggggagaagggcgccggccgctccgggaagcccctccactacaagggctcgagcttccaccgcgtgatcccggggttcatgtgccagggcggcgacttcaccgccgggaacgggaccggcggcgagtcgatctacggctccaagttcgccgacgagaacttcgtcaagaagcacaccggcccgggtgtcctgtccatggcgaacgccggcccggggaccaacggctcccagttcttcgtctgcaccgccaagaccgagtggctcgacggcaagcacgtcgtgttcgggcagatcgtggacgggatggacgtggtgaaggccatcgagaaggtggggtccagctccggcaggacctcgaagcccgtcgtcgtcgcggactgcggccagctttcctagatcgggcggtccccgtcggtcgccgggatctccccccccccccccctccccgtgtgcgtgtgggatcttatctgatctccagtccgtttccgagcatggtgttttagggctttcctttttttttcggcttttagcgtgtggggtgttcggccagatctggttatgggtctctccgcggatccttgttgtctgtaggatcgtcgagaccttttatgatggttatgttgaactgccagtcggccattaactgctggaaaaataagatagggagcttttcttgaaatgcgaccctctttttaccctgtaaaaaaaaaa

SEQ ID NO: 46 - DNA, 900 bp, Eucalyptus sp.
tctcgatctcgaactctctacctgttgatccgtgttgaccatgccgaacccgaaggtcttcttcgacatgacgatcggcggggcggccgccgggcgggtcgtgatggagctgtatgcggacacgaccccacgcaccgcggagaacttccgggcgctctgcaccggcgagaagggggtcgggaggagcaagaagccgctccactacaagggctccaagttccaccgggtcatacctagcttcatgtgccagggaggtgacttcacggccgggaatgggaccggaggggagtccatatacggagtgaagtttgcagatgagaacttcataaagaagcacacggggccggggatcctgtccatggccaacgcagggccagggacgaacgggtcccaattcttcatatgcactacgaagacggagtggctcgacgggaagcacgtggtgtttgggaaggtggtggagggaatggaagtggtcaaggccatcgagaaggttgggtcctcttccggtcgcacatccaagcccgtcgtggttgctgattgcggccagcttccttgagccataataatagagatctctctctcacacacaatggcttcttcatataataaaaagtgtcacctatgaagtgttcaatgttgtcgatcttttgtatgtgctcgtttgaggtttgattacttcttggtcgtgcactcctgaaaagaagagaagatctcacccgtttttcgttttcaatgggataatctcgtattacttggctgaaaataaggtgaaacatttacttgccttgcaagagggaaacttttgacaaggtttggaacataaattgttgaatacgatgtattataatgttggtgtcttggtgaaatacagaattatgcttgcgtggaaaaaaaaaa

SEQ ID NO: 47 - DNA, 824 bp, Eucalyptus sp.
gcagcagcgtagcagcttttatggccgccggtcgccgatcgctcaactccttcgctcctccttctcctccttcgtcttcgccgatcgctgtggctgatctcgtcgctccggcttttcataaaaatcatggctgaggcaatcgatttgacgggtgatggaggggtcatgaagacaattgtgcgacgagcaaaaccggatgcagtctctccttcagagacccttcctcttgttgatgttcgttatgaaggagtacttgctgaaactggtgaagtctttgactcaacacatgaagacaatactctattctcctttgagatcggaaagggctcggtgatcagtgcttgggacactgcattgagaactatgaaggttggggaggttgcaaaaatcacatgtaagccagaatatgcctatggcagcacgggttctccacccgatatcccaccagatgcaacccttatttttgaggtggagttagttgcatgcaaaccgtgcaagggcttttcagtgaccagtgtcacagaagacaaggctaggcttgaggagctgaagaagcaaagggagatagctgccgcaaccaaagaggaagagaagaagaggagggaagaagctaaagctgcagctgctgctcgtgttcaagccaagctggatgctaagaaaggtcacgggaagggaaagggaaaagcaaaatgaacagctttataaggaatactcaagtagatcataactcagttttccttcatatgccttttaaacttggctaggatcttaaccttgagtattatggaatataagttaagaccagacttcccataaaaaaaaaa

SEQ ID NO: 48 - DNA, 843 bp, Eucalyptus sp.
ctgcaagcgtgctcggagatcgtggagatggcgacggcgagatcgtttttcctctgtgctctgctcctcctcgcaaccctatatctcgctcaggcgaagaagtctgaggatttgaaagaggtgactcacaaagtttattttgatgtggagatagctggaaaaccggcaggtcgaattgtcatgggtctatatggaaaagcagttccaaagactgctgaaaacttcagggcgctgtgtacaggtgagaaaggcactggaaagagtggaaaacctcttcactacaagggaagcagtttccaccggatcattccaagcttcatgctacagggaggtgacttcactcttggtgatggcagaggtggcgagtctatttatggagagaagtttgctgatgaaaactttaagttgaagcacactggaccagggcttttgtctatggcgaacgctggtcctgacacgaacggttcacagttttttatcacaactgtgacgactagttggcttgatgggagacacgtcgtgttcgggaaagtgttgtctgggatggatgtggtttacaaagttgaagctgagggaagacagagcggcacccccaaaagcaaagtcgtgatagcagacagtggtgaactcccactctgatcgaactgatgccaacatgtttaccatgactagctcttaggcagcagttaagagataaatgcaaaaacagtgtaggttatgtgaaaccgaaaactggatttggagttatagccgtgctcttctttttgggcatttcggttgttctaatgtgtctggagtgaatatttttcaatatgatgtaattttgcctttgtaaaaaaaaaa

SEQ ID NO: 49 - DNA, 1165 bp, Eucalyptus sp.
tcgacattgaggatccgggagccgactcccttcgctcgatggaggttcgaggggtcgcggcctgacgacgatcgagggcgcccgccttcctatgccatcttctcatcttcttcatcttcttccgcggctcgggaatgatgcgtcgagagatctcggtcctgctccagcctcgcttcgtcctcgccttcctcgccctcgccgtcctcctcctcgtcttcgccttccccttctcgagacagagaggagaccaagtagaagaagaacctgaaattacccacagagtatacttggacgttgacattgatggacaacatttaggtagaattgtgattggattatatggcgaggtggtaccaagaactgtagaaaatttccgggctttgtgcacaggggaaaagggcaagagtgccaatggaaaaaaactccactacaaaggaacaccttttcaccgtataatatctggcttcatgatccaagggggagatgtaatctacggtgatggaaaaggatatgaatccatatacggtggcacctttgctgatgagaattttaggataaagcattcccacgcaggtatcatttccatggtgaattctggccctgactctaatggatcacaattctttattaccacagtcaaagccagctggttggatggagagcatgttgttttcggcagggttattcaaggcatggacactgtctatgcaatcgaaggtggagctggaacatacaacggaaagcccagaaagaaagtcataatcgctgactctggagagattccgaaaagtaagtgggacgaggaaaggtgaccactttttgtttttgggtacacgcagttaggataactagcatgaaagcccgatcccgcatatacaggacttggaggcgagttctcttctttggtcgacattctttgccccgtcttttgtccagaaacctggctacccagctaactccaacgctcatattcaccatggtacagttcttggaaatgccatgggtctgtacccgacttctacgatgtattctttgtaaagatgaatgggttcactcaactttttttctggccttttgtcttgtgtctgctgttccattcatgagcagtctacaggagtttggtctcatcacccagtccacgacgtatgagtcctgataagaattt

SEQ ID NO: 50 - DNA, 866 bp, Eucalyptus sp.
gggagcagcgcatttcatcagacatttggtgagcgacaccatctcccctgcaagaaaagagaacctctcgcggctcctctcccggcgtggccctcgtagctggctttgtgcgtagaagatgtgggcgaccgcggaaggaggtcctcccgaggtcactctcgagacctccatgggttctttcactgtcgagctatacttcaagcatgcgccgaggactagccggaacttcatcgaactctctcggaggggttactacgataacgtcaagttccaccgaatcatcaaggacttcatcgtgcaaggtggggatcccaccgggactggaaggggtggagaatcgatctacggtaaaaagtttgaggatgagataaaaccagaactgaagcacacgggtgcaggtatcctgtccatggcaaatgctggaccaaacaccaacggcagccagttcttcatcaccttggcgccatgcccttcacttgatggaaaacacacaatatttggacgagtatgcagaggaatggagattatcaaaagacttgggagtgtccaaacagacaacaatgatagaccgatccatgatgtgaagatattgcggacatcagtaaaagattgatttcgagggagttaattttcactgactgggtgttctgtgataccgtctttcaactgcacattgatcatggagccatatctgtccaacatttgtaatattgtgcaatggcgttagtatcatctgatgcatgttatcgccggtcacttctcttcgacaaaagatacattatgcaatgcgttgatgctttgtcaggattatgtcagcttgggacaaatttggggcaatttcatggcatatgaactcaacaggatct

SEQ ID NO: 51 - DNA, 655 bp, Eucalyptus sp.
gaacttcgattgcagttcacaagaggttgtggctaggatgtcgaatccaaaggttttcttcgacatattgattggtaagatgaaagcaggcagggttgtgatggagctctttgcagacgtcacgcccaagaccgccgaaaatttccgcgcactgtgcaccggggagaaggggatcggcagatctgggaaaccgctgcattacaagggatcaacctttcaccgtataatcccaaacttcatgtgtcaaggcggggatttcactaggggcaacggaaccggaggggagtctatatacggaatgaaatttgccgatgagaacttcaagattaagcacaccggcctgggagtgctgtcgatggccaacgcgggacccgacaccaatggctctcagttcttcatatgcaccgagaagaccccgtggctggatgggaagcacgtcgtgtttgggaaggtcatagacggttataacgtggttaaggagatggagagcgtgggttctgatagcggaagcacgagggaaacggttgcaatcgaagactgcggtcagctatcagagaattgatggctagcactgtgtagaaaggtgaatttaaagtacttgtctacactgcttattaaatcattgtggatgagccccttaaaatttcttatgatg

SEQ ID NO: 52 - DNA, 2078 bp, Eucalyptus sp.
gaagaaggaggaggagccgaagtgcctgcattccgagagccgaagtgcgttggcttcccttgcgatcgttcctccgtttcgtgatccgacccgaagaccccgcgcgccatggacgacgacttcgagttcccggcctcgagcaacgtcgagaacgacgacgacgacggcatggacatggacgacatgggcggggacgtccccgaggaggaggacccggtggcgagccccgccgtcctcaaggtcggcgaggagagggagatcgggaaggccgggttcaagaagaagctcgtcaaggaaggcgaagggtgggagaccccgagctccggcgacgaggtcgaagtgcattacacggggactctgctcgacgggaccaagttcgactcgagccgcgatcgtgggacgccgttcaagttcaagctcggtcgaggtcaagtgatcaagggatgggatgaagggatcaagactatgaagaagggtgagaatgccatattcaccatccctccggaacttgcctatggtgaatcgggatcccctcctaccattcctcctaatgccactcttcaatttgatgtggagttgctctcatggagtagtgtgaaagatatatgcaaggatggagggatcctcaagaaagttcttgtggaaggagagaagtgggataatcccaaggacctagatgaggtttttgttaaatatgaagcaagcctcgaagatgggacgctcatttcgaaatcagatggggtggagttcactgtgggagatggatatttctgcgctgcgttggccaaggctgtaaagacaatgaagaaaggagagaaggttttgctgacagtgatgccacaatatgcatttggggagactggcagaccggcttctggggatgaggctgctgttccccctgacgctagcctccaaattatgctcgagctagtctcttggaagaccgtttctgatgtaaccaaagacaagaaggtcttgaagaaaactttgaaggaaggagaggggtatgagcgcccgaatgatggggcagctgttcaagtgagactctgcggtaaactccaagatggaacggtctttgtgaagaaggatgacgaggagcctttcgagttcaaaatagacgaggaacaagtgatcgatggacttgacagagctgtcaaaaacatgaagaaaggggaagtggcattggtgacaatccagccggagtatgcctttggcccgaccgaatctcaacaagatttggctgttgttcctgccaactccactgtgtattatgaggtcgagctgttatcattcgttaaggagaaagaatcatgggagatgaacaatcaggagaaaattgaagctgcagcaaggaagaaggaagaggggaatgctgcatttaaagctggaaaatatgtaagggcttcgaagagatatgagaaggcagtgaggtttatcgaatatgattcatcatttagtgatgaggagaagcagcaggcaaagaccctaaaaaacacctgcaaccttaacgatgcagcttgcaaattgaaactcaaagacttcaaggaggcagagaaactgtgcaccaaggtattggaaggtgatggtaaaaatgtgaaggcactctaccggagggctcaagcttacatacaacttgttgatttggatcttgcagagcaggacatcaaaaaggcattagagattgaccctaacaacagggatgtgaaactcgagtacaagatactgaaggaaaaagtgagggaatataacaagagagatgcccagttctatgggaatatgtttgccaagatgaacaaactggagcattctagaacagcgggcatgggggcaaagcatgaggcagcacctatgacgatagatagcaaagcgtagattgtactcgtgaatagctaatggtgatgtatgtttggagtccgcttgagtaatgtgtacccacatcaactgtccatgtattccttaacagacgctaaaaactcgtctatcgacttgagactgtcttggcgtgtattttggaataaactattatcacgttttgttaaatataataccaaaactccgtgctgtgaataaaaaaaaaa

SEQ ID NO: 53 - DNA, 1435 bp, Eucalyptus sp.
ttttggtttgtttccttctttcccgccgtggaggaggagaagagtctagagagagagagagagagagagggagatggcgaagccgaggtgcttcatggacatcagcatcggaggggagctcgaaggcaggatcgtcggcgagctctacaccgacgtcgcccccaagacggccgagaatttcagggccctctgcaccggcgagaagggcattggccctcacaccggcgcccccctccactacaagggggttcgctttcatcgtgttatcaaaggattcatggtgcaaggtggagatatctctgctggtgatggtaccgggggagaatctatctatggcttgaaatttgaggatgaaaattttgatctgaagcatgaaaggaagggaatgttatcaatggcaaactctggcccaaacacaaatggctcccagttcttcatcacaacaacccgcacttcgcatctggacggaaagcatgttgtgtttgggagggtagttaaaggaatgggagtggtccgatcagtcgagcatgttacaactgctgctggtgactgtccaactgttgatgttgtaatcgctgactgtggagaaattcctgctggggcggatgatggcattagaaatttttttaaggatggcgatacttacccagactggcctgcagatcttgatgagagtcctgctgaactttcttggtggatggatgctgtagattctatcaaggcattcgggaatggaagttataagaaacaagattacaaaatggctctcagaaagtatcgaaaggccctgcgctatctggatatctgctgggagaaagaagggattgatgaagttgagagttcatctttgaggaaaacaaagtcacagatattcaccaatagttctgcttgtaaattgaaactatgtgatctcaagggagcattgttagatgcagaatttgctgttcgtgatggagaaaacaatgcaaaagcttattttcgacagggacaggctcatatggaacttaatgatatcgatgctgcagcggaaagcttctctaaggcgttggagttggagccaaatgatgttgggatcaagaaagagcttaatgctgccaagaagaagatttttgagaggcgcgaacaggagaagagggcatatcggaagatgtttctatagcagattctctactattgcagaggaaagcacaaagattcttggcaaaccaactgtatagattggaggcagggatcagatcaagatttttatttgcagttaaatagagttgaaattcattaggataagagtttttgttttacacccgggggggggaccatcgtcgttgcccaaatggcatgaccaggacattttggaactggacatttttagtcacttctccacgtcgtttcggtttaactctaatgggagcgttgggtgttcagggcaaaaaaaaaa

SEQ ID NO: 54 - DNA, 2342 bp, Eucalyptus sp.
tctcgctctaaactccaagttctaaacttgaagcattcttgaagttgcgggacatgactaagagaaagaaccctctcgtcttcttagatgtgtcgattgatggggatcctgtggagagaattgttattgagctctttgctgacactgttcccaggacagcagaaaatttccgatcactctgcacaggagagaaaggagtggggaaaactactggcaagcctctgcactacaaaggatcgtactttcatcgaattattaaagggttcatggcccaaggtggtgatttttcaaatggaaatggcactggtggagaaagtatatatggagggaagtttgctgatgagaatttcaaactagcacatgatggacctggtcttctctctatggcaaatggtgggccaaataccaatgggtcccagttcttcataatattcaagcgccaacctcaccttgatgggaagcatgttgtatttgggaaggttatgaggggaatggaagttgtgaagaaaattgaacaggtaggaagtgccaatggaaaacccctccaaccggtgaaaattgtagattgcggtgagacttctgaaacaggaacacaagatgctgttgtggaggaaaaaagtaaatctgcaacactaaaagcaaaaaagaaacgatctgcaagagattcgtcttctgaatcccgaggaaaaagacgacagagaaaatcccgcaaggagagaacgaggaaacgaaggagatactcttcatctgattcctacagctctgagagctctgatagcgattctgaatcttattcctcagacactgagtcagaatccaaatcacactctgagtcatcggtatctgattcaagctcaagtgatggaaggcgcaggaaaaggaagtcaacaaaaagagaaaaacttcgtcggcaaagagggaaggatagtcgtggggagcaaaagagtgccagatatgacaaaaaatcaaggcacaagagtgcagatagttcaagtgattcagaaagtgaaagttctagccgtagtaggagtagagatgacaagaagaaatcttctcgacgtgagtctgctcgaagtgttagcaagttaaaagatgccgaagcaaattctcctgagaatttagaatcaccaagggatcgtgaaatcaagaaagttgaggacaactcatcacatgaagaaggtgaattttcaccaaagaatgatgttcagcataatggacatggtactgatgcaaaatttggtaaatatgatgatcaacgtccccgttcagatggttcaaagaagtccagcggaagcatgagggacagccccaaaaggttggctaacagtgtccctcagggaagtccatcaagcagtcctgcacataaagcctctgaaccttcttcctctattcgtgcccgcaatccatcaagaagccctgcgccagatggtaattcgaagcgcattagaaagggccgtggcttcacagaacgtttctcctatgcccgtcgatatcgtaccccatctccagaagatgtaacatataggccctaccattatggtagaagaaactttcatgacaggaggaatgataggtattcaaattacagaagctattctgagcgctcaccacacagaagatacagaagccccccaagaggcaggagccctccaagataccaacgaagaagaagtcgaagcaggagtgtgtctcgcagcccgggtggtaataaaggccgataccggggtcgggaccagagccggagcaggagcaggagcaggagtcggagccctagacgtggttctagtccagcgaataagcaattgccactgagcgagaggttgaaatcacgtcttgggaccagagtcgatgagcattctccacgcagaagaaggtcctcctcgagaagccatgattcctcaagatctagatcccctgatgaagtaccagacaagcatgagggcaaagctgcccctgtatctcctgcaaggtctcgatccagctccccttctgggagggggttggtctcctatggcgacgccagtcctgattctgggatcaactaaagggtcttccacttcacatcatcacgattggccgagagatttgatgatctgtggagtacctgcgcccaacgttttgagtcaggtggactcgcatggggtgtgcaaccgttggaatgaaccaagagcggcttggaccagcctcactcggtcggtattatgtactcggtaaatgaaatttaatgacatagctgctggatttttacgaggtcatcttaaacgttctgagaatttcctgagatcatggccctctcatttgcatcttataaaactttagtagacttggattgaaaaaaaaaa

SEQ ID NO: 55 - DNA, 2044 bp, Eucalyptus sp.
tcgatacctcctcggagccggaggtttctgtcggggggaggccggggcgaacatgtcggtgctgctcgtgacgagtttaggggacatcgtggtggacttgcacgccgataggtgccccttgacctgcaagaacttcctcaagctctgcaggatcaagtactacaatgggtgtgtgtttcacactgtgcagaaggatttcacagcacagacaggcgaccccactgggactggaacaggcggcgattctgtttataaatttctttatggtgatcaggctcgctttttcatggatgagattcatcttgatcttaaacactccaagacaggaacggttgccatggcaagcggaggagaaaatctcaatgcttctcagttctatttcacattgcgggatgatttggattatctcgatggaaagcacacggtgtttggtgaagttgcagaaggccttgagacattaactaggattaatgaagcctatgtagatgagaaggggagaccctataagaacatcaggatcaggcacacatatatattggatgacccttttgatgaccctccccagctagctgagttgattcctgatgcttctcctgaaggaaagccgaaagatgaggtggtcgatgatgtgcgacttgaagatgattgggtacctttggatgagcaactaggcccggctcagcttgaggaggctattcgtgctaaggaagcacactcccgtgcagttgtgcttgagagtattggagatattcctgatgctgagattaagcctccagataatgtgctctttgtttgtaaactgaatccagttaccgaagatgaggacttgcatacaatcttttcacgatttggaaccgtggtatcggctgacgttatccgtgattttaagactggagatagtttatgctatgcattcatagagttcgagaacaaagattcatgtgagcaggcatattttaagatggacaatgccttgattgatgataggaggataaaggtggatttcagccagagtgttgcaaaactttggtcccagttcaaacgaaaagatagccaagcagctaaaggaaaaggttgctttaaatgtggggctcctgatcacatggccagggaatgtcctggaagctccactagacagccactttcaaagtacattctgaaggaggacaacgcacagaggggtggagatgactctaggtatgaaatggtctttgatgaagatgcaccagaaagtccaagtcatggaaagaaaaggcgaggacgagatgaccgggatgatagacataagatgagcaggcaaagtgtagaagaaacaaaattcaatgatagagagggagggcactcagtggataagcataggcagagtgaaagaagtaagcatagagaggatgagatgagtcgagacagtaaagctagtgaggctggtaggagaaggattgacagggattttcccgaagaggaaagagatggagagaaatatacggagagtcacagagacagagatggtaagagaggtgattatcgagattatagaaagggaagagcagatgttcagactcatggagacaggagaggtgatgaaaactataggagaaagagtgctgcttatgatgatggccatgagggtgcgggagctgctaggagaaaagattccaatgatgatcaccatgcatataggagaggatatggagattctaggaagggaactagagatgaagatgacgatggacgaggaaggagggatgaccctagttataggagaagcagtggacacaaggatagctccaacggtggaagggaagagcagaagtatagaagtggagagacagatggcaaaagtcatccggagagaagccatcgaggtgataggaggagatgaagggcgggccagagtacagagacatttcttctactggagagctcccttgtagggatgggtgcctaatgctgtcccgtcggggtgctgcatgactttaaatagctgattctgaccatatcctaaaattctggttttgattgggtcattttgcactcaaaaaaaaaa

SEQ ID NO: 56 - DNA, 1044 bp, Eucalyptus sp.
gcgagcatgaggcctttcaatggcggatcctccatcgcttgcctcgtcctggtgatcgccgccggcgcgctggccgagtcgcaagggccccacctcggatcggctcgcgtcgttttccagactaattacggggacatcgagttcgggttctttccgggcgtcgctccgaggacggtggatcacatcttcaagctcgtccgcctcgggtgctataacaccaatcacttcttccgggtggataaaggttttgttgcccaagtcgctgatgttgccaacgggagaaccgcgcccatgaatgatgagcagagaacggaagccgagaaaactatcgttggggagttcagtaatgtcaagcatgttaggggcattctttccatggggagatatgacgatccagacagtgcacaatcctctttctcaatacttctcggagatgctccgcatcttgatggcaagtatgctatatttggtagagttaccaaaggtgacgagacattgaaaaagcttgagcagctacctactcgccgtgaagggatgtttgtaatgccaactgaacgcatcacaattctatcatcatattattatgatactggggctgagagttgtgaagaggagaattcaactttgaggcgcaggcttgctgcttcagctgttgaggtagagagacagaggatgaaatgcttcccgtgatgctttctagatcattggaaggaagtggtctgatttccttatcattcatccattgtgctttgatgtatcctcagtgtactgcttttagctatgtatagatcgagtcaactcattgaagatatggggaaggaagattcaactgttccattcattctgtaagtttaacaaaaagcatgaagatgaaggttactttgtgagaacattcttgtccactaagctgacattgttagtggatttacttgagaggtgagaaatgaaagatcatagacattttcacttccaaagttgggaactcaagccatttatccatatatatattgttcctgaatgctgttttttcagccaaaaaaaaaa

SEQ ID NO: 57 - DNA, 1012 bp, Eucalyptus sp.
agaaagtaaggttgatcaatttggcggaaagtcaggcttttggtgcagctttttgcagaatctcagaggtttcgaactcaggatgccgaacccaaaggttttctttgatatgcaggtcggcggtgccccagccggccggatcgtgatggagctctatgcggatgtggtgccaaagacggctgagaacttccgcgcgttgtgtaccggcgagaaaggcaccggccgctcaggcaagcctctgcacttcaagggttcgtcgttccaccgtgtgatcccagggttcatgtgccagggcggtgacttcacaaggggcaacggtaccggtggagagtcgatctacggcgagaagtttgccgatgagaactttgtaaagaagcacacggggcctggcatcctctccatggccaacgccggccctaacactaacggctcccagttcttcatctgtaccgcccagacctcgtggctggatggtaagcatgtcgtatttggtcaagttgtagagggcttggaggtcgtgcgcgatatcgagaaggttggatctggatctggcagaacttcaaagccggttgtcattgccgactctggacagctcgcttgaatttttattatttaccttcgcctttacgctgcatacgttaataggttattatttccttcaaccattacgctgcataggttgttagcgtattgtttccctttaccattacgctgcatgactccctagggtttgtcagcataggcgttttaagggttttttgcatctttctactcaagatagtcgctgcataagttcctagggtttgtcagcaaagaggcttcaaaggtttttgtgtcttttctagttattataaacgcttcataggttcctagggtttgtcagcatatagatttcaagggtttttttagatctttggagttgagataaacgctatggcaataacccagtaatgtttgtttttatcatatgaaatttttacatctggagttgcattcgcagtaaaaaaaaaaa

SEQ ID NO: 58 - DNA, 627 bp, Eucalyptus sp.
cttgcttgcggctcgggatccgatcaacaacacacgtttcaacagataccgacgattcctgtccttagaaacacgttcgacatcttctatctcttgtcgaaatcacacaaatcaaaatccaatcatgcgtttcaccagcatcaccagcgccattgcgctcttcgccgccgctgcttcggcgctcgacaagccgttggatatcaaggttgacaaggcggtcgagtgctcgcgcaagaccaaggccggcgacaagatccaagtgcactaccgcggcaccctcgaggcagacggcagcgagttcgacgcctcgtacaagcgcggccaaccgctcagcttccacgtcggcaagggccaggtgatcaagggatgggaccagggcctcctcgacatgtgccccggcgagaagcgcactctcaccatccagcccgactggggctacggcagcagaggcatgggacccattcccgccaacagcgttctgatcttcgagaccgagctcgttgagattgctggtgttgccagagaggagctttagatgggtaatttgtccatgacaatcgtagtcgaagacacgatacgctcttagatggtacggaaatctgatttgagctttctccaaaaaaaaaa

SEQ ID NO: 59 - DNA, 862 bp, Eucalyptus sp.
tgaattttcccgagaaaaccaggaacctgccaaatatctctctgaaagatctccatgggtaacccgaaggtgttcttcgacatgtcgatcggcggccagccggccggccggatcgtgatggagctctacgccgacgtggtgccgcgcacggcggagaacttccgcgcgctctgcaccggggagaagggcgccggccgctccgggaagcccctccactacaagggctcgagcttccaccgcgtgatcccggggttcatgtgccagggcggcgacttcaccgccgggaacgggaccggcggcgagtcgatctacggctccaagttcgccgacgagaacttcgtcaagaagcacaccggcccgggtgtcctgtccatggcgaacgccggcccggggaccaacggctcccagttcttcgtctgcaccgccaagaccgagtggctcgacggcaagcacgtcgtgttcgggcagatcgtggacgggatggacgtggtgaaggccatcgagaaggtggggtccagctccggcaggacctcgaagcccgtcgtcgtcgccgactgcggccagctttcctagatcgggcggcccccgtcggtcgccgggatctccccccccccccctccccgtgtgcgtgtgggatcttatctgatctccagtccgtttccgagcatggttttttagggctttccttttttttttcggcttttagcgtgtggggtgttcggccagatctggttatgggtctctccgcggatccttgttgtctgtaggatcgtcgagaccttttatgttggttatgttgaactgccagtcggccattaactgctggaaaaataagatagggagcttttcttgaaaaaaaaaa

SEQ ID NO: 60 - DNA, 1158 bp, Eucalyptus sp.
atctcccatggctgctgacgactgaccccccgtcaaagcgcagagaagagacagcgaccgcgcacccgcaaggccctccgccctctccggcgagtcacgggagaaagacgggaaatttaagcgggggaggagagcgaattcggggaatggccgtcgcgacgaggtcgagatgggtcgccatgtcggtggcgtggattctggtcttgttcggaaccctggctctcatccagaaccgattaagcgacaccggagcttcgtctgatccgaaacttgttcatcgcaaagttggtgaggaaaagaagaagccggacgatttggaagaagtgactcacaaggtttttttcgatgtcgagatcggaggaaaaccagcgggtcgaattgtcatgggcctctttggcaaaaccgtccccaaaacagtcgaaaacttccgagctctttgcacgggggagaaagggattggaaagagtgggaagcccctgaattacaaagggagccaattccacaggatcattcctaaatttatgatccagggcggtgacttcactcttggagatgggagagggggagagtcaatctatgggaacaaattttctgatgaaaacttcaaactgaagcatacagatgcagggcgcctttcgatgacaaatgctgggccagacacaaatgggtcacaatttttcattaccactgtgacaactagctggttggatggccgccatgttgtgtttggaaaggtgctgtctgggatggatgtcgtccacaagattgaggctgaagggggacagagcggccaacctaaaagtatcgttgtcatttcagacagcggagaattagatctatgaacacttccctgcacactcccctccaggttgcacttgacaagtttgacctcatagcttactcgacacgaatgtagggctcaggcatcgtgcactgctttgatgcaaatgtttttttttctttaatggtgaagaagaaaatgtgaggcaagcttgttgatttgatattgggacatacttgaaagagcttggatcgatcatagaagccagccatgaatagagataacttttctgagtgtgaattggatattacgttgcaaatagccgaatgaaatgtagaaaacaggatgtttgttctgaaaaaaaaaaaaaaaaaaaa

SEQ ID NO: 61 - DNA, 758 bp, Eucalyptus sp.
gggaagaatcccgtccggtggaaacccgaacgccgttcgttccctctcgacgagtcgccggcgaagctcagctcgtcgaaacgagcaaagaatctctcctcctcctcctcctcctcctcctcctcccgccgccgccgcctccgccgccgcagcagcagcagtcgagatggccgtcactctgcacacgaatctcggcgacatcaagtgcgagatcttctgcgacgaggtccccaaagctgccgagcacaatgcaaggggaatactctcaatggctaatagcgggcctaacaccaatggaagtcaatttttcatcgcatatgcaaaacaaccacatctgaatggattatacaccatctttggcagagtgattcacgggtttgaggtcctagatatcatggaaaagactcaaacagggccaggggacagacctcttgcggagatcagactcaatcgtgtcacaattcatgcaaatcctcttgctgggtagcctttcttgatgggtttttttttttcttatcttgataggactcttttacagttttgctttaggttagggatccctgtaagctgatgatagatattggagatggtacttgtaagattcaattacatcgaactacttcaaaccttgtattggagcattccaaatacaaaagatcgaaagatgcttgttgatatgtgccggtggctcatctgttgtgctggttgcatgatggtctttgtttgcgatgtattcgccgttcatctcaaaaaaaaaa

SEQ ID NO: 62 - DNA, 1104 bp, Eucalyptus sp.
agtcgaagacgaaagaggaaaagcaagctcctcgaagagagctcgagcatctcccatggctgctgacgactgaccccccgtcaaagcgcagagaagagacagcgaccgcccacccgcaaggccctccgccctctccggcgagtcacgggagaaagacgggaaatttaagcgggggaggagagcgaattcggggaatggccgtcgcgacgaggtcgagatgggtcgccatgtcggtggcgtggattctggtcttgttcggaaccctagctctcatccagaaccgattaagcgataccggagcttcgtctgatccgaaacttgttcatcgcaaagttggtgaggaaaagaagaagccggacgatttggaagaagtgactcacaaggtttttttcgatgtcgagatcggaggaaaaccagcgggtcgaattgtcatgggcctctttggcaaaaccgtccccaaaacagttgaaaacttccgagctctttgcacgggggagaaagggattggaaagagtgggaagcccctgaattacaaagggagccaattccacaggatcattcctaaatttatgatccagggcggtgacttcactcttggagacgggagagggggagagtcaatctatgggaacaaattttctgatgaaaacttcaaactgaagcatacagatgcagggcgcctttcgatggcaaatgctgggccagacacaaatgggtcacaatttttcattaccactgtgacaactagctggttggatggccgccatgttgtgtttggaaaggtgctgtctgggatggatgttgtccacaagattgaggctgaagggggacagagcggccaacctaaaagtatcgttgtcatttcagacagcggagaattagatctatgaacacttccctgcacactcccctccaggttgcacttgacaagtttgacctcatagcttactcgacacgaatgtagggctcaggcatcgtgcactgctttgatgcaaatgtttttttttctttaatggtgaagaagaaaatgtgaggcaagcttgttgatttgatattgggacatacttgaaagagcttggatcgatcatagaagccagccagaat

SEQ ID NO: 63 - DNA, 899 bp, Eucalyptus sp.
cttctctgccccttgaattttcccgagaaaaccaggaacctgccaaatatctctctgaaagatctccatgggtaacccgaaggtgttcttcgacatgtcgatcggcggccagccggccggccggatcgtgatggagctctacgccgacgtggtgccgcgcacggcggagaacttccgcgcgctctgcaccggggagaagggcgccggccgctccgggaagcccctccactacaagggctcgagcttccaccgcgtgatcccggggttcatgtgccagggcggcgacttcaccgccgggaacgggaccggcggcgagtcgatctacggctccaagttcgccgacgagaacttcgtcaagaagcacaccggcccgggtgtcctgtccatggcgaacgccggcccggggaccaacggctcccagttcttcgtctgcaccgccaagaccgagtggctcgacggcaagcacgtcgtgttcgggcagatcgtggacgggatggacgtggtgaaggccatcgagaaggtggggtccagctccggcaggacctcgaagcccgtcgtcgtcgccgactgcggccagctttcctagatcgggcggcccccgtcggtcgccgggatctccccccccccccctccccgtgtgcgtgtgggatcttatctgatctccagtccgtttccgagcatggttttttagggctttcctttttttttcggcttttagcgtgtggggtgttcggccagatctggttatgggtctctccgcggatccttgttgtttgtaggatcgtcgagaccttttatgttggttatgttgaactgccagtcggccattaactgctggaaaaataagatagggagcttttcttgaaatgcgaccctctttttaccctgtaaaaaaaaaa

SEQ ID NO: 64 - DNA, 3478 bp, Eucalyptus sp.
agaagagattgctggttttggcagagggcggaggcgcagataagaagagggaggcgatagagcagctccttcgcgaaaaatcctcttcatcgcttcgcttcgggttggggcggaggtcggctcctgttagggtttcggccggccagatccgcgggcggatctctcctttctccgggtttggatgagcccggtcgctgcgaacgccatggaggaggcggcggaacccgaggtcccagctcccgtcactcccagcaaggacgacgccgacaccgacgccgccgtgtcccgcttcttgggattctgcaagagtaaattgggcctggccgagggaaattgcgtgcagtcttcgacgctgctgaggaaaaccgcacatgtgctgcggtcgagtgggactgttatcggtactggaacggcggaagaagcagaacgctattggttcgcttttgtgttgtacactgttagaagggtaggcgagaggaaagccgaggatgagcaaaatggatcggacgagactgaggtccctttgtcccggatattgaaagcttcagtactaaacctcatcgactttttcaaagagattccgcaatttgttatcaaggctggggcaatcgtaagcggcatatatggtgctaattgggacagcaggctagaggccagagagatgcagacaaactacgtgcatttatgcattttgtgcaagttttataaacgtatatgcggtgaattcttcattctaaacgatgcaaaagatgatatgaagtccgctgattcaagcacttctgaccccgtgattatgtaccaacctttcggatggttgctgtttttggcgcttagaatacatgccttgagccgatttaaggaccttgtttctagcacaaatgctttggtctctgtactggctattctaataattcatcttccaacccgcttcagaaaattcagcatttctgactcatcacaacttgttaagagaagtgagaagggggttgaccttgttggatcactcgcttatcgttacgatacctcagaagatgagatcaagagaacattggaaaaagccaataacgtgatagcagaaattttggggataactccgcctccagcttcagagtgcaaagcagagaatctggagaatgttgacacagatggtttgatctactttggaaatctcatggaggaaacatctttgtcatccattttaagtactttagaaaaaatttatgaagatgcaactcgtaatgacagtgaattcgatgagagggtatttataaatgacgacgacagcttgcttgtatcgggtagcttgtctggggccgccattaatttaactggtgccaagaggaaatatgactcatttgcctcccctgcaaagactatcacaagaccactctctcccagccgctctccagcatctcacatcaacggtataattggtggcactaatttgaggatcactgctactcctgtggccactgctatgacaactgccaagtggcttcggacgttcgtgtccccactcccatcaaaaccttcgactgatctacagggatttctagcgtcatgcgatagggatgtgaccagtgatgtgatacgtagggccaatataattttggaggccatctttccaaacagtcctattggcgagcgtactgtaactggaggcttgcaaaatgctaatctcatggacaacatgtgggctgagcaacgaaggctggaagcccttaagctttactatcgggttttggaagctatgtgtagagcagaggcacaaattttacattcgaataatttgacctctttgttaacaaatgagaggtttcataggtgtatgcttgcatgttccgctgagttggttcttgcaacacataagactgtgacgatgttgtttcctgcagtgctagagcgaacaggtattacagcttttgaccttagtaaggtgatagagagttttgttagacatgaggaaactcttcccagagaattaagaaggcatctgaatacattagaagagcgacttctagagaacatggtgtgggagagaggttcttcaatgtacaattccttggtagtggcaagaccagctcttgctccagagataaatcggctaggcctattaccagaaccaatgccgtccttggatgccattgccttgcttattaatttttcttccagtggattgccccagtcaccggtgcaaaagcacgaggcttctcctggtcagaatggggatatcaggtctcccaagagaattagtacagaataccggagtgtattagttgaaagaaacttcacttcaccagtaaaagatcgactgttagccttgagcaatatcaagtcaaagctaccgccacctccacttcagtctgcatttgccagtccaactcgaccacatccgggaggtggaggggaaacatgtgcagaaaccgcaatccatatattctttagcaagattactaagctggcagccgtcagaattaatgccatgcttgaaaggctacaactctctcagcagataaaggaaggtgtttattgcctatttcagcaaatactcagtcagcgaactaatctcttctttaatcgccatattgatcaagtaatactctgctgtttctacggtgttgcgaagatcaatcaaataaacctgacctttagggagatcatttacaactataggaagcaaccccagtgcaagccacaagtgttccgcaatgtttttgttgattggtcaacccggcggaatgggaaagcggggaatgagcatgtggatattatctctttctacaatgaaatattcattccttctgtgaaaccgctgctcgttgaacttgggcccacaggagcaactactagaacaaaccggacttctgaagttggcaataaaaatgatgctcaatgccctgggtcacctaagatatcttcttttccaactctcccggatatgtcccctaagaaagtatctgcatcccacaatgtctacgtatctccactgagatcatctaagatggacgcttcaatctctcatagctcgaaaagctattatgcttgtgttggagagagcacccatgcctaccaaagcccttccaaagaccttgttgccatcaacagtcgcctgaatggtaaccgaaaggtgagaggcacgcttaattttgatgatgttgacgctggcctcgtcagtgactctatggtggccaacagcctctaccttcagaatgggagcagtatgtcttcatcaactgctaaatcatctgagaaaccagaatcataaagttaaatgatccccagtcccattcccatgcatgtaaattccagttttcttgttcccctcaactggctaaatcaggaagtggaagcgtgcagtgagttatttgtataatagctgccctttccttatcttctgtccatgagactgctgcaagcaagttactttagcagtttagtttaataaaatccaatcaccttcacatggtgaaaaaaaaaa

SEQ ID NO: 65 - DNA, 1463 bp, Eucalyptus sp.
cccacaccgctcggctagggtttctctccaacagcgcacggacaggaagagcagagacccgccggcggttacaccctcctccgccgccccccgccgaatcgaggccgtggcagccccaccggagctccgagaagcgagggcgttttccgattcgatcgccgaccatgaggccgattctgatgaagggccacgagaggccgctgacgttcctcaagtacaaccgggagggcgacctcctcttctcctgcgccaaggaccacacccccaccgtctggttcgccgacaacggcgagcgcctcggcacctaccgcggccacaacggcgccgtctggtgctgcgacgtctcccgggattcgatgaggctgattaccggaagcgcggacacgacggcgaagctgtggagcgtgcagaacgggacgcagctgttcacgttcaacttcgattcgccggcgaggtcggtggatttctccatcggcgataagctcgcggtgatcaccaccgatcctttcatggagctgccttcggctattcacgttaagcgcattgccagagaccctgccgaccaggctagtgagtctgtcctcgtccttcggggccatcaaggaagaatagctagagctgtctgggggcctctgaacaagactatcataagtgctggagaggatgctgtaattcgcatttgggactctgagactgggaagcttctcagagagtcagacaaggaaactggccataaaaaggcagtaacttcacttatgaaatccgttgatggttcccatttcgtcactggttcacaagataaatctgccaagctatgggacatcaggacgttgactctaattaagacatatgtgacagagcgccctgttaatgcggttacaatgtctccgcttcttgatcatgtggtccttggaggtggccaagatgcttcggctgtgaccatgactgatcatcgtgctggaaagtttgaagccaagttttttgacaagattcttcaagaagaaattggaggtgtgaagggacactttgggcctattaatgctttggctttcaatcctgatgggaaaagtttctcaagtggaggtgaggatggttatgttaggttgcatcactttgacccggattacttcaacatcaagatttagcttttgagaaaatagttttgcagttttgaaaatttgcttctgtattggctcttgatcattgtggagagagtattgtgacaaagaaacaactgccttctcggaggttgggggaagtacacattgtggaaagatatcgttgtctgtatgttggggcgagttttatgggaaaaggctctgccttcagagtggcggaatttttccagaatgtttattatcatgttattttcctatcttagattggaaattttgttttcaaggttaggttgtctaaattatgaggatcttaatgaaaggagctatttcctagcaaaaaaaaaa

SEQ ID NO: 66 - DNA, 1861 bp, Eucalyptus sp.
gaacgaggaaagcccgcggatttggacaagtataagaaccgggctgccattgcagcgagcttctctgcgtctcgccccttcgagtccggctccgttgatctttcggttttttttttgcccaattttcggtttttttttttgggttttccataggttttctttgttctttggtcgggcttcgatccgcattgaaccttcttagcagattagtcagtgaagtgcgaacacccacgaattttttttttttttttccttggcaaaagatcggatcccagtgttttgggatcaatccctctgtaaatcgccgcaggaaaggaggagaatttcaaagcattttcgtgttttcgatttaccctcttgtaagatagctagtgatcagctctttccgtgctcaaatcgttggttgcttttttgaggtttcctggatcttgggtcagattgaattttagggctttcttctcttttgttattttgggggtgcttaccctcttttggcggttcctcgtaatttatttcttgtggttcgaaatggacaagaagaggacggtggtgccgctcgtgtgccacgggcattcgcggccggtggtcgatttgttttacagcccgatcacgccggatggcttcttcctcatcagtgcgagcaaagattctagcccaatgctgcgaaatggagagactggagattggattggaacctttgagggacataaaggtgcagtctggagctgctgcctggacactaatgctctacgtgctgcatccggctctgcagatttctccgcgaaactgtgggatgcattgtccggggatgaattgcactcttttgaacacaagcacattgtccggtcatgcgccttctcagaggacactcatctcttgctgaccggcggtgtcgagaaaattcttcgaatttttgacttgaaccgaccagatgctcctcccagagaagttgacaattcaccaggttcaataagaactgttgcatggctccatagtgatcagaccatattaagttcctgtactgatattggtggcgtaaggttatgggatgtaaggagtgggaaaattgttcaaactttggagacaaaatcccctgtcactagttctgaagtgagtcaggatggtcgctatattaccacagctgatggttcgaccgttaaattctgggatgcaaaccactttgggttggtgaagagctacaacatgccctgcaatatcgagtcagcctcattggaaccaaagcttgggaataaatttattgctggtggagaagacatgtgggttcacatttttgatttccatactggagaagagattggatgcaacaagggtcatcacggtcctgtccattgcgtgcgattttcacccggtggggaatcctacgcatctggatcagaagacggcactataagaatttggcagactgggcctgcaaataatgtcgagggtgatgcaaatccaagcaacggcccagtaactggtaaagcaaaagtcggggcagatgaagttactcgtaaagtggaggacttacaaattggcaaagaagggaaagattggcgagaaggataatgctgcagacgcatgatgtgctctttaggtttgatctgtctgttttgtctatcctgcgagtttcgagcatgtgcgtgtgtgatgcttgtgctttgcaaataaagtggacatgctcttgataagtttctttcctctgccatccttttaaatgaatctcccttggaagctcgctttctcctcttgttcctcttgtaacagcagacaccgccgaagtttggagacttcatttttatgctttccggattgtgcttaatgaagaagaatctggaattttgctaaaaaaaaaaaaaaa

SEQ ID NO: 67 - DNA, 1348 bp, Eucalyptus sp.
cctaattcccaggggaaggggagtatatagcctcgcttccatccagccattcatctctggtcgcgccttttgcctccagctcgccgaagaagaaagcccccccggcagaaccgccgcccccctcctcctcctcctcgccggaaccaccgtgagcaatggcggagggactaatcctgaagggcacgatgagggcccacaccgacatggtgacggccatcgccatcccgatcgacaactccgacatggtcgtcacctcctcccgcgacaagtccatcatcctctggcacctcaccaaggaggagaaggtctacggcgtcccccgccgccggctcaccggccactcccacttcgtccaggacgtcgtcctctcctccgacggccagttcgccctctccggatcctgggacggcgagctccgcctttgggacctcgccaccggcgtatccgcacgcaggtttgtgggccacaccaaggatgtgctttctgtggcattctccatcgacaatcgccagatcgtgtcggcatctcgtgatcgcaccatcaagctgtggaatacattaggagagtgcaagtacacaattcaggagggcgaagctcatactgattgggtcagctgcgtgaggttcagtcccaacacactgcaacccaccattgtgtctgcttcatgggatagaaccatcaaggtctggaacttgaccaattgcaagcttagaaacaccttggcggggcacaatggctatgtgaatacagtagctgtatctcctgatgggtcgctctgcgctagtggtggcaaggatggagtgattttgttgtgggacttggcagagggcaagaggctgtataatctggaggctggtgctataattcactctctttgcttcagccccaatagatactggctctgtgccgctactgagaacagtattaaaatctgggacctcgaaagcaagagtatcgtcgaagatttgagggttgatttgaaaaacgaagctgacaaaactgatggaaccacgaccgctgcttcaaataagaaggttatatactgcacgagcttgaactggagtgcagatggaagcaccttgttcagtggatacaacgatggcgtgatcagagtttggggcactgggcgttactaattcgaggaactgccagtcggccttttcttgatcttttcttgaagacttaggatgatgtcttgaaagtgttgcaagtaatttttgtttcacatgacgtgcggttgtttcggttttgtggccaagtaatctttggtttttttcccataatttttaaaatgtacgctggtcctcaatgtagttgatttgtagctgattctgttccaaaaaaaaaa

SEQ ID NO: 68 - DNA, 1271 bp, Eucalyptus sp.
ctcttctcttcctctccgtcgccgctctctctctcctcctcctcctcctcctcccgcagcagcagagaaaccctaatcgaagagcagacatggcggaggggctgcacctgaaggggacgatgaaggcccacacggacatggtgacggcgatcgcggtccccatcgacaacgccgacatgatcgtgacctcctcccgcgacaagtccatcatcctctggcacctcaccaaggaggacaaggtctacggcgtcccccgccgccgcctcaccggccactcccacttcgtccaggacgtcgtcctctcctccgacggccagttcgccctctccggctcctgggacggcgagctccgcctctgggacctcgccaccggcgtctccgcccgcaggttcgtgggccacaccaaggatgtgctctcggtggccttctcgatcgacaaccggcagattgtgtcggcgtctcgtgaccgcacgatcaagctgtggaacactctgggagagtgcaagtacaccattcaggaaggtgaggctcacaatgattgggtgagctgtgtcaggttcagtcccaacacccttcagccgaccatcgtgtccgcatcttgggaccgcactgtgaaagtgtggaatttgaccaactgcaagctgaggaacaccctgcaggggcattctggctatgtgaacaccgtggctgtgtctcctgatgggtcactttgtgcgagcggtggcaaggatggagtgatattgctttgggacttggcagaagggaagaagctgtactcactggaggctggtgccattattcactcactttgcttcagtccaaataggtactggctctgcgcagccacagagaacagcattaagatctgggatctggagagcaagagcattgtcgaggacttgagggttgatttgaagaatgaagctgatatgagtgatggaactacgggggccatgagctcaaataagaaggtcatctactgcacgagcttgaactggagcgctgatggaagcaccttgttcagtggttacaatgatggcgtgatcagagtctggggaatcgggcgttattaggaaatttttgacgatcgctactgctgaactgtttttcaaagattccctttttcgtatgtctttttagtggtttaaagaaccttttaggatcttgtttaagatgcttggagcaatatatgcctgcctctactcttatgtttagaagatttggcctttgggcagtcatatttttttgagaacagagatataaaaaaaaaa

SEQ ID NO: 69 - DNA, 1264 bp, Eucalyptus sp.
cgctctctctctctctcctcctcctcctcccgcagcagcagagaaaccctaagcgaagagcagacatggcggaggggctgcacctgaaggggacgatgaaggcccacacggacatggtgacggcgatcgccgtccccatcgacaacgccgacatgatcgtgacctcctcccgcgacaagtccatcatcctctggcacctcaccaaggaggacaaggtctacggcgtcccccgccgccgcctcaccggccactcccacttcgtccaggacgtcgtcctctcctccgacggccagttcgccctctccggctcctgggacggcgagctccgcctctgggacctcgccaccggcgtctccgcccgcaggttcgtgggccacaccaaggatgtgctctcggtggccttctccatcgacaaccggcagattgtgtcggcgtctcgcgaccgcacgatcaagctgtggaacactctgggagagtgcaagtacaccattcaggaaggtgaggctcacaatgattgggtgagctgtgtcaggttcagtcccaacacccttcagccgaccatcgtgtccgcatcgtgggaccgcactgtgaaagtgtggaatttgaccaactgcaagctgaggaataccctgcaggggcattctggctatgtgaacaccgtggctgtgtctcctgatgggtcactttgcgcaagcggtggcaaggatggagtgatattgctttgggacttggcagaagggaagaagctgtactcactggaggctggtgccattattcactcactttgcttcagtccaaataggtactggctctgcgcagccacagagaacagcattaagatctgggatctggagagcaagagcattgttgaggacttgagggttgatttgaagaatgaagctgatatgagtgatggaactacgggggccatgagctcaaataagaaggtcatctactgcacgagcttgaactggagcgctgatggaagcaccttgttcagtggttacaatgatggcgtgatcagagtctggggaatcgggcgttattaggaaatttttgacgatcgctactgctgaactgtttttcaaagattccctttttcgtatgtctttttagtggtttaaagaaccttttaggatcttgtttaagatgcttggagcaatatatgcctgcctctactcttatgtttagaagatttggcctttgggcagtcatattttttgagaacagagatataatacctgtttttacggcaaaaaaaaaa

SEQ ID NO: 70 - DNA, 1770 bp, Eucalyptus sp.
ttttttttttggtttttctttcaatacttatcttttattcatcaaagcgagctgaggcggagagggagggaggacatggttaaagttcaaaagctaaagtacaacagcgtttacatggaagacacttattagagagacccatccatgagtgtaagcttcatgaccgagtctccggcacgacaaaaaccgccgacgcgatcttctacttcttgccaccggttgccttcttcttaggctgagccggcttcggctcggccttcttgggggccggcttggatgtcaggggttccagcgccgccattcgcgacaaccacgccggagaacgggacgatgagcagcaactcgccggccttccaccgcgattccgacgacgacgacgaccagggcgaggtcttcctcgacgactccgacatcatccacgaggtcgccgtcgacgacgaagatcttcctgacgccgacgatgaggcagacgaggcagaggaagcggatgactctttgcacatattcacaggccacaatggggaagtgtacagccttgcatgcagtcccacagatgcaacactagtggcaactggggctggagatgataaagggtttctgtggaggataggtcatggagattgggctgttgagctccaaggtcataaggattccatctctagtttagcgtttagtctggatgggcagttgcttgcatctggaagccttgatggagtcatacagatttgggatgttccatctggaaatcttaaaggcacccttgatggacctggagggggcatagagtggatcaggtggcatcccaagggacacataatattagcaggttcggaggattccactgtttggatgtggaatgctgacaagatggcctacttgaatatgttttcagggcatggtaacagcgtaacgtgtggagattttactcctgatggtaaaacaatttgtaccggctcggatgatgcaacattgagaatttggaatcccaagagtggggaaaacattcatgttgtaaaaggtcatccatatcatgccgaaggactaacaagcatggcaataagctctgattcaggtcttgctattactggtgccaaagatggatctgttcgcattgtcaatatatcaagtggaagggttgttagttctctggatgctcatgcagattctgtcgaatttgtgggactggctctaagctccccgtgggctgcaactggaagcttggatcagaagctcattatatgggatctccagcattcttctccccgcgccacctgtgatcacgaggatggagtgacttgcttgagttgggtcggtgcatcaagatttttggcctcgggttgtgttgatggcaaagtacgagtgtgggatagcctttctggtgattgcgtaagaacatttcatgggcattccgatgctattcagtccctgtcggtgtctgccaatgaggagttccttgtttctgtttcaattgatggaactgctagggtttttgagattgcagagtttcactagggataacaccggatgcacgatattgtttttgtctgtacattttctgtactctaaaactatgatcttttctttttgtagcagaaacaccccccccccacccccccacaaaccccccacaaaaaagaaaagcatattatctttttgaagcggaaatatatatttatgctactacataagtaatgtactacttgacaagatgaggaaagtatttgtttcgcggtgtgatttagttgatcaatttacattttaaaaaaaaaa

SEQ ID NO: 71 - DNA, 1613 bp, Eucalyptus sp.
caaaacttcaacgaagttccgttgattaaggaatgggaacctctcagcatcaattatcttcatgcctccagcttcttccaagacgccgaggaaataagaacctcattttcagacggacgatggccagcggtggcgccgccgccgtcgccccgccgccgggctacaagccctaccgccacctgaagaccctgaccggccacgtcgccgccgtctcctgcgtcaagttctccaacgacggcaccctcctggcctccgcctccctcgacaaaaccctaatcatctggtcctccgccgccctctccctcctccaccgcctcgtcggccactccgagggcgtctccgacctcgcctggtcctccgactcccactacatctgctccgcctccgacgaccggaccctccgcatctggtcctcccgctcccccttcgactgcctcaagaccctgcgcggccacaccgacttcgtcttctgcgtcaacttcaacccgcagtccagcctcatcgtctccgggtcgttcgacgagacgatccgcatctgggaggtcaagaccggccggtgcctcaacgtgatccgggcccactccatgcccgtcacctccgtccacttcaaccgcgacggctccctcatcgtctccgggagccacgacgggtcgtgcaagatctgggacaccaagaacggggcctgcctgaagacgctgatcgacgacacggtgcccgccgtctccttcgccaagttctcgcccaacggcaagttcatcctcgtcgccactctcaatgacaccctcaagctgtggaactatgcaactgggaagttcttgaagatttacacgggtcataagaacagcgtctactgtttaacttctacattctctgttacgaatgggaagtacattgttagcggctcagaggatcggtgcatctgcatatgggatctccaagggaaaaacctaattcagaaactcgaaggccactctgatacggtcatttccgtcacgtgccatccatcggagaacaagattgcatctgctggccttgattccgatagaactgtgagaatttggcttcaagatgcttaactgcttaggctgtgatggatagatggatttcaagctgtttccctggattttggggagggtaatttgcaggtgaagtgggctcgagcaagcaaagtgctcttccttgttctgatgtgggttcaagctttgccatcctcgcatgtgatggatacaataatctaccaaaggctacttagaccgacaagcaggatgaatgggtgaagtccaaaataattggaacacttttggggataagttgttactagattatgatccagcatagatactcgatgtggtatagaatttatccaatgtactcctaaatgtagatacatcgtgtattgatttctccccatgtttgaggatactcagcctgaattacgtatctaatgggttgtcctgaaagtgtaagtcctacgtcattcctgataaggctctttttctgtttctcataggtgccccattggttctgaagaaacacttccatcaaaataagtttcattgaatgtgtacgggttcttttcttagtaacagctccatctatttgtaaaaaaaaaa

SEQ ID NO: 72 - DNA, 1150 bp, Eucalyptus sp.
ctgattcgcagattcgcgcagacgaggaaattagtggtcaagaggagaagagaacttagtcatcatgccttctcaaaagatcgagacaggtcaccaagacatagtccatgatgtagctatggattactatggaaagcgtgtggcaacagcttcgtctgataccactatcaagataataggcgtgagcaatagctctggatcacagcaccttgcttcattgagtggtcataaaggccctgtttggcaggttgcttgggcacaccctaaatttggatcaatccttgcttcttgctcatatgatggacaagttatcttatggaaggagggtaatcaaaatgattgggctcaagctcatgttttcaatgatcacaagtcatccgtgaattccatcgcttgggcgcctcacgaactaggtctctgcttggcttgtggttcatctgatgggaatatctctgtctttactgcccgacctgatggtggttgggacacaactaggatagagcaagctcaccctgttggtgtcacttctgtttcatgggccccgtccatggctccgggtgctctagttggatctggtttgctagatcctgttcagaagctggcctctggagggtgtgacaatacagtgaaggtgtggaagctttataatggaacttggaagatggattgcttccctgcccttcagatgcactctgattgggtcagagatgtggcttgggcacctaatttggggcttccgaagtccacaattgctagtgcttctcaagatgggactgttgtaatatggactgtggccaaggaaggagagcaatggcagggtaaagttttgaaggatttcaagactccagtttggcgggtttcctggtcgcttactggaaatttgttggcagttgctgatgggaataacaacgtaactttgtggaatgaggcagtggatggtgagtggcaacaagttactacagttgagccatagatttggagtttgtctgttttgttatctactttaatgtgttttgccttgcctaggacctctttgatagactgttattgttatggtgtttctctttttgattttagagtttgtgaatacaattattttaacataatcttttcttgggagatgaatgaaggggtattatcaaaaaaaaaa

SEQ ID NO: 73 - DNA, 1341 bp, Eucalyptus sp.
ccaaccaaaccccaacactctccagctctactctctctctctactttctctctccatctccttcgccggaattcgaatgagatgaagatcgcgggcctcaagtccgtcgagaacgcccacgacgagtcggtgtgggccgccgcgtgggtgccggcgacggagtcccggccggcgctgctcctcaccggctccctcgacgagaccgtgaagctgtggcggcccgacgagctcgccctcgagcggaccaacgccggccacttcctcggcgtcgtctccgtcgccgcccacccctccggcgtcatcgccgcctcggcctccatcgacagcttcgtccgggtcttcgacgtggacaccaacgccacgatcgccacgctcgaggcaccgccgtcggaagtctggcagatgcagttcgatcccaagggcaccactctagcggtggcaggtggagggagcgcatcaatcaagctttgggacactgccacatgggaactgaatgcaaccctctcgattcctcgtccagaacagcccaaaccctccgaaaaaggcaacaagaagtttgtcctctctgtcgcgtggagtcctgatggcagaaggcttgcctgcggttcaatggatggtacaatctctatattcgacgtggctcgggccaagtttctgcaccacctggaaggccacttcatgccagtgcgatctctcgtattttccccagttgagccacggctgcttttttctgcatccgacgatgctcatgtgcacatgtatgattccgaaggtaagtccttggtggggtccatgtctggccatgctagctgggtattgagtgttgatgtcagcccggatggagcagcacttgcgacaggttcaagtgacaggactgtgaggctgtgggatctcagtatgagggctgccgttcagacgatgagtaaccattcggatcaagtttggggggttgcctttcgaccaatggcgggtgctggtgtcagagctggtggtcggcttgctagtgtatctgatgacaagagcatatcactctatgattactcatgaaggtatatctgcaaattgtgaaaagataagttcttggagccactgatcgttaaccttttgtttgaatagtctgcaagagattttcttggtttcagatcatttttatttgtataattagctgactatgatgactttcggagaaatggctcaatataggtctgatctgatgggtgccgtgtattaacttcgaggtcaatttgatacccgatatttctgagaggtttttttgtgaagttatattgactatgggggttactatcactaatcagctcagctgttgatataaaaaaaaaa

SEQ ID NO: 74 - DNA, 1401 bp, Eucalyptus sp.
gcaagatcgattgctctgtagagcaaaggaaaggagaaaagcatggagatcgatctcggaaacctcgcattcgacgtcgattttcatccatcggagcagctcgtcgcctccggcctcatcaccggcgacctcctcctgtaccgctacggcgacggctcctcgccggaaaagttgctggaagtgcgagcgcacggcgagtcttgtcgggctgttcggtttatcaacgatgggaaagcgattctgaccggttctccggattgctcgattctcgcgacggatgtggagacgggatccgtcgtcgctcgagtcgaaaatgctcacgaggctgctgtcaataggttggtcaatttgacggagtctactattgccacgggagatgataatgggtgcatcaaggtttgggacaccagacaacgttcttgctgcaacacatttagtgcccatgaagatttcatatcggacatgacatttgcatctgattccatgaaacttgttgtcacaagtggagatgggactctatctgtttgcaatcttcgaagtaataaagtccaaactcggtccgagttctctgaagatgagttactatctgttgtcattatgaagaatggaaggaaagttgtttgtggaacacaaagtggaacattattactatattcatggggattcttcaaggattgcagtgatcgctttgtggatctctcccccagctcagttgatgcgttgctaaagcttgatgaggataggatcattgcaggaactgagaacggacttatcagtctgataggaatattacccaacagaatcatccaaccgattgcagagcattcagatcatcctattgagcgccttgccttctctcatgataaaaagtttcttggcagcatatcgcatgatcagacattgaagctctgggatttgaatgacatactagggtctgaagattctccatcaagtcaagcagccatagacgacagtgatagcgatgagatggatgtggatgcgaatcctcccgattctagcaaagggaacaagaagaagcattcaggcaaaggaaatgatgttggcaatgccaacaactttttcgccgacttaggcgattgatggctccaatcttcatatgcacatgacaagttgaggttcatacaaacatatcaaggctcgattctagtcggcacatttggcaagcaattcgtacatgttttcattgacagtgtgttctcaggggggaattttgacaggactccatgaccaggggcttcttattgtttatctgacattcccagggatgtaataccccatcttaaactcaaacaagtttatgtattttgagtgttctaggacaactatatatacaaagtagaaatccaaattgcaaaaggcatattcctcctaaaaaaaaaa

SEQ ID NO: 75 - DNA, 1467 bp, Eucalyptus sp.
ggggaaagtcaagctgtctttcatcatggtcatttgtccgatcacgatcgcccgttccggcgatcgagacggcgacttcagctgctgattagccacgttcgattccgtctgatttggtcggaaaaaaaaaggggtttgaaaatgagtcagcagccgtcggtgatcctcgcgaccgccagctacgatcacaccatccgattctgggaggccaagagcgggcgatgctacagaacgattcagtacccggattcgcaagtcaaccggttggagataactccacataagcggtacctggctgtggcgggaaatcccagcataagattgtttgatgtcaactcaaacacccctcaaccggtgatgagtttcgactcccataccaataatgtcatggctgtggggtttcagtatgatggaaattggatgtactcaggctctgaagatggaactgttagaatatgggacctgagagctcgtggttgccaaagagaatatgaaagccgtggagctgtaaatacagttgttctgcacccaaatcagactgaactaatatcaggagaccaaaatggaaatatccgtgtatgggatttgacagcgaattcatgcagctgtgagttggtaccagaggtggatacagcggtcagatccttaacagttatgtgggatgggagtctggtggttgctgcaaataataatggaacatgttatgtttggcgcttgttgcgtgggagtcagacaatgaccaactttgagccacttcataaactacaagcacataatggatatattcttaaatgtcttctttcacctgagttttgtgaaccccacagatatttggctactgcttcttctgaccataccgtcaagatttggaatgttgaaggtttcactctagaaaagactttgataggacatcaacgctgggtgtgggactgcgttttctcggtagatggtgcttatcttataacagcttcctcggacacaacagcaagactctggtccatgtcgactggtcaagatatcagggtgtatcaaggacatcataaagcaactacttgctgtgccctccacgatggtgcggaagggtctccaggctgatattggaaaaacgctagggcttaaaccgcatcagttcgcaattcccctaacggaggccgactgttttccttttgagtaaaaaagttcgttgttgtccgaacaatcacattcttcgcagattaaagtgcacataagttgctagcgttggactatccaagttgtcttttgaatatcgaaatgatgaatttccgagggaaacagggcaagagatgaaagcttgaagctttttagcacggccagctcatgactcgtggatctcagatgtcccaagttttccggtctttctactttattgcagaaagtggtgggttcactgaattgcttgtaaatatactcaataatcaatgtagttgttcgtcgataaaaaaaaaa

SEQ ID NO: 76 - DNA, 1407 bp, Eucalyptus sp.
cctcctcgaagcaggcagctgaaactactagctggacggagctcgggagagagagcaaagatggaagatgccatggacatggaagtggaagtggaagtggaagcggaagaacactctccttccagctcgaatccgagcggctcttccttccgcagattcgggctcaagaactcgatccagaccaacttcggcagcgactacgtcttcgaaattactcccaagtttgattggtcgctgatgggggtatcgttgtcgtccaacgcggtgaagctgtattccccaacgacgggtcagtactgcggagagtgcagggggcactccgataccgtcaatggcatttcgttctcgggaccgtcgagtccccacgtcttgcactcttgctcttccgatggcaccatccgagcttgggacaccaggtcttttaaagaggtttcttgcataagtgccgggccatcgcaggagatcttcagcttttcgttcggtggttcaagtgacagtcttctttctgctggatgtaaatctcagatactcttttgggattggagaaacaaaaagcaggttgcatgtttagaagattctcatgtggatgatgttacccaggtttgctttgtccctcaccatcaaaataagcttatttcagcttcagtggatgggctgatatgtatatttgatacggctggagacatcaatgatgatgagcatatggaatcggtgattaatgtgggaacttcaattggcaaagtggggatatttggacagacatttgaaaagctctggtgtttgacacatattgagaccttaagtgtttgggactggaaagagggaacaaatgaagccaactttgaagatgcccgaaaattagcatctgatagctggtcactagatcatattgattattttgttgactgtcactcagctgaagaaggtgaaggtttgtgggtgattggtggcacaaatgccgggactttaggatacttccctgtaaagtacaagggaggggcagcaataggatccccagaggccgttcttggaggtggccactcggatgtggttaggagcgttttgcctatgtcgggcatggcagggacaacttccaaaacccgaggcatttttggatggacgggtggcgaggatggtcgcttgtgttgctggctttctgatgactcttccgctacaagccgatcgtggatgtcaagcaatctggtcttgaagtcatcgagaagtcaccacaagaaaaataggcaccaaccttactagtttttttgtcagatttgcttcttttatttccatgtatcaagccgcatcaatgtttgtcgctgcaattaacatgtgtgcagtcgatcccgtatttgattgattttttgtaatatattacagagcgacccgtgttctgtactaaaaaaaaaa

SEQ ID NO: 77 - DNA, 1910 bp, Eucalyptus sp.
gaatcgacgaacaacgcatcgccgatgcagcgaaatcctctggatcattgattctccctcccttcccccacgagttaaaagaaaaatcaatcaaggaatttctacagggaacgaacaaaaattcaacgagctcccggattcgttattgcctcgccccgccccgcccgtcgatttcgcggttggttgggttacatgtctcagcaccaagagtatccgatggaatacgcagcagatgattacgatgtgggagaagtagaagatgatatgtacttccatgaaagagtaatgggcgattcagacaccgatgaggatgaggaatatgatcatctggataataagattaccgatacctctgctgctgatgctcggagaggtaaagatatccaggggattccttgggaaagactgagcgtcactcgtgaaaaatacagaagaactagaatagagcagtacaagaactatgaaaatgtaccacaatccggagaaagttcggaaaaggattgcaaacccacaagaaaaggtggaaactattatgagttttggcgaaacacaagatctgtgaagtccacaatccttcattttcaattgagaaacttggtttggtccacgacaaagcatgatgtttaccttatgtcgcacttctcgatcattcactggtcgtcattgacttgcaagaagactgaagtgcttgatgtttatggacatgtagctcctcgtgagaaacaccctggaagtctcttagagggttttacacagacacaagtcagtactcttgcagtacgggataaattactgattgctggtggtttccagggggagcttatctgtaagaacttagatcgtcctggtgttagctactgttgcagaacaacttatgatgacaatgctatcactaatgcggttgagatttacgattatcccagtggcgccgtacatttcatggcatcgaataatgactgtggagtcagagatttcgacatggagaaatttgagctctccagacatttcacctttccttggccggtgaatcatacttctctgagtcctgatggtaagctcctcgtcattgttggtgacaaccctgaggggatagtggtggattctcaaagaggaaagaccattaggccactacaagggcacttggatttctcatttgcatctgcatggcatccggatggtcacatatttgccactggaaaccaagacaagacttgccgtatctgggacattcgcaacttatcaaagtccgttgctgtactcaagggcaaccttggagccatccggtccattcggttcacctccgatgggcgatttatggccatggcagagcctgctgattttgtccatgtctatgatgtgaagagtgggtatgagaaggagcaggagatcgatttttttggcgagatctctggtgtgtctttcagccctgacactgaatcgctatttgttggggtgtgggatcgcacctatggcagtctccttcagtataaccgatgcaggaattattcatatctcgactccatgtagtgaggagatgcctgcaccgtttcttaactaaataactgcaattatataggattcttgaaatatggctaaagtggcttcagcgcattgtgtaaatgtagataggtgatatatttctcgttgcaatgtagggtaagagaacaagtatggtgttacttggtggatcattgtcttccttctttaggtcatagaatgcttgctcttcattggaaggttgagcgagaagagagagagagagagagagagagagagctttatggtgatgaagtgttctgttgtttgcagaataatggagatgtatttaataaaggttggtggtgtttgggtgaagattgaagcaaactcttctcattgccaataagaaccctattcactttctctgtcaa

SEQ ID NO: 78 - DNA, 1356 bp, Eucalyptus sp.
ctctctctcggcggctccacctcaaaaccctatcccgaaacctcctcgccggggagagctcgaatcgagcgccgtcgagtgccgatccgaccgggagggacgaaggaaatgggggcgagcagcgacccgaacccggacgtctccgacgagcaccagaagcggtcggagatctacacgtacgaggcgccgtggcacatctacgccatgaactggagcgtccgccgcgacaagaagtaccggctcgccatcgccagcctcctcgaccacccggccgccgccgccgccgtccccaaccgcgtcgagatcgtccagctcgacgactccaccggcgagatccgggccgacccgaacctctccttcgaccacccttacccggccaccaaggcggccttcgtcccggacaaggactgccagcgcgccgacctgctcgccacctccagcgacttcctccgcatctggcgcatcgccgacgactcctcccgcgtcgacctccgctccttcctcaacggcaacaagaacagcgagttctgccgccccctcacctccttcgactggaacgaggcggagcccaagcgcatcggcacctccagcatcgacaccacctgcaccatctgggacatcgagcgcgagaccgtcgacacccagctcatcgcccacgacaaggaggtctacgacatcgcctggggcggcgtcagcgtcttcgcctccgtctccgccgacggctccgtccgcgtcttcgacctccgcgacaaggagcactccaccatcatctacgagagctccgagcccgacaccccgctcgtgcggctcgggtggaacaagcaggacccccgctacatggccaccatcatcatggacagcgccaaggtcgtggtgctcgacatccgctaccctaccatgccggtcgtcgagctgcagaggcaccaggccagcgtgaacgccatcgcgtgggcgccgcacagctcctgccacatttgcacggcgggggacgactcgcaggcactcatctgggacctgtcatcaatggcgcagcctgtggagggcggcctggacccgattctggcctacactgcaggggcggagattgagcagctgcagtggtcgtcctcgcagcctgattgggtcgcgatcgccttctctttgaaactccaataatcacatttaccatcaacaggcatcagcaacatactgttgtagtgtaattaatttaatggaaaagttcatttgtgtggtgggccttggaaagtgacttattggtgccctgttcattggacttgagtgactggtgaaactgatgttgctgatggctgttgatggtaaatgtgattattggagtttcataaaaaaaaaaaaaaa

SEQ ID NO: 79 - DNA, 1596 bp, Eucalyptus sp.
gtcaacactcaaaagcagcagctcaagtggccagcgcttcccgcggattagagaaatccgcagatcggcgatgcgcggcggcggcggcggcggcgacgcgacgggctgggacgaggacgcctaccgggagagcgtcctgaaggagagggaagtccagacccggaccgtgttccgcgccgccttcgccccctcgccgagccctagccccagccccgacgccgtcgtcgtcgcctccagcgacggctccgtcgcctcctactccatctccgcctgcctgtccgaccacagattgcagtcgttgcggtttgctgacgcgaagtctcaaaacgttctagaggcggaacccgcttgtttccttcaggggcatgatggacctgcctatgatgtcaaattttatggcgagggtgaagattctcttctactgagttgtggtgatgatggacggattcgggggtggatgtggagagacattacgagctcagaggcgcatgaccattcacaaggaaacagtgcaaaaccagtacttgatttggtgaatccccaaagtagaggtccttggggtgccctttcaccaatccccgagaacaatgccctggctgtagatgttaagcggggatccatttatgctgcagctggtgattcttgtgcatattgttgggatgtggaatgtggtaaaataaaaactgttttcaaagggcattctgactacctgcactgtatagctgcacggaactcttctagtcagattataacaggttctgaggatgggacagcaagaatatgggattgcagaagtggtaagtgtgtccaagtaattgatccagacaaagaccataagaaaggtttcttcgcaagtgttagttgtcttgctcttgatgcaagtgagagttggttggtctgtggtcggggtcgggatttatctgtctggagtatatctgcttctgattgcatagcaaaaatctcaaccaatgctcctgcacaggatgtcttatttgatgataatcaaatattactggttggagctgaacctttgatcagtcgtttagacatgaacggggcggttctttctcaaatacattgtgcacctcagtcggtgttttctgtttctctgcatcaatctggtgtaactgcagtcgggggttatggaggcttagtcgacgtaatctcccagttcggaagccacctctgcacatttcgctgcaaatgcatatgaatgaaaaactgcatcgacatgatattcttgtaacgaacctgcagtgctaagcccatgcctcggaggaaatatggttgctccaaagaaccttgtgcatttgccttagttaaccttatctggcaaggagttgacctgacttttgctaaaatctgaggttttggatctgtgggctgctcttttctttcactaagtttgacaaagagggtgcttgcttgcagcctgaacatgccgtgaaatgtagtagcgtagagaaaaaagagagctcgacttcgttatcgcaggagacttttgtgtggaccattatactccttttgatagatttttccttctaaaattttgtatcttgtaaaagatttggtgatttcaacgtttagaaggctaat

SEQ ID NO: 80 - DNA, 1824 bp, Eucalyptus sp.
tctctctctcctctccctcccaacctttctctctcctcccgacctcgactgcggatggcgtcgtcgccggagtcacgcgctgcctgctgaagcgatacggcggcgaccatggaggctccaatcatcgatccgctgcagggagatttccctgaagtgatcgaggagtacttggagcatggcatcatgaagtgcatcgccttcaaccgccgcggtaccctcctcgccgctggatgcaccgatggaagttgcattatatgggactttgagacccggggcgtcgcaaaagagctccgagacaaagaatgcactgctgcaattacgagtgtctgctggtccaagtatggtcaccgcatacttgtgtctgcttctgataagtctcttattctttgggatgttctaagtggagagaagatagcacatacgactcttcagcataccgttctacaagcttgtcttcatcctggttcctcaactccatctatttgcctggcctgccctttctcatctgctcccatgattgttgacttgaacactggaagcacaacagctcttccagttttgactgctgatgtgagcaatggagccactcctctgtcccgcaacaagacatcagatacatcagtaacttactctccatgcaatgcctgctttaacaagcacggggatctggtttatgcaggaacctcgaagggagaaatacttataattgatcacaagaatgtcagagtgtgtgccatcgtccttgtttctggtggcgcagttataaaaaatgtcgtgtttagtagaaatggacagtacatgttgacaaattccaatgaccggctgattagaatctataaaaatcttctacctcctaaagatggattaaagatgcttgatgaattgaatgagagcttcaatgaatcagatgatgtggagaaattgaaggctattggatcgaagtgcttagaacttctccatgagtttcaagattccatcactagggtccagtggaaagcaccttgttttagtggtgatggagagtgggtgattggtggtgctgcaagcagaggagagcacaaaatttatatatgggatagggccgggcatcttgttaaaattcttgaaggcccaaaagaagcattgatggatttggcatggcatcctgttcatcccattatcatttctgtttctttgactggcttggtttatatatgggctaaagactatactgaaaattggagtgcatttgctccagatttcaaagagctcgaggagaatgaggagtatgtcgaacgagaagatgaatttgatctggtgcctgaaactgaaaaggtaaaaggactagatgttcatgaagatgatgaagttgatgttttgactgtggagagggattcagtttttagtgactcagatatgtcccaggaggaactatgctttttgcctgcagttccttgtctcgatattcctgagcagcaagacaagtgtgttggcagttgttcaaagttgccagatggtaaccattctggatcgccactttcagtagaagctggtcagaatggaaatgcaagcaaccataattcaagccctctcgaacctatggagaattcaactgctgatgacacagacggagtgcgtttaaaaagaaaacgcaaaccttcggagaaggggttggaattgcaggctgagaaggtcaagaaacctgtgaaacctttaaaatcgtctggtagattgtcaaaaactaataaacctgtgattgatccggattctagtaatggtgtatatggagatgatggttctgattgatttgattaaattgcagttctcatttcttcaaaaaaaaaa

SEQ ID NO: 81 - DNA, 3007 bp, Eucalyptus sp.
aaaaaacagacgaccagaggaagatttctctttcctgattctagggtttccttcccctttcgtcttcttcgtcttccgctccatcaatcggctccgacacccgcaggcaccgaggcagcttcgtcgcccccgcggccgaagaggacgggtcaaggttgcaaattttgcccaatcccgcgcagattccgcgcccctcgccggcgtcgcgtcgtgtcggaggaggaaaatggcacgtccgagcagggcggcccggaaatggggagcgtgctgatcgcccgagagggatcgggcgcggcggcgagagctggatttgggttccctcgcaggagaattgtggatgcatgaggctgctccgaggatataatgaggggtgtctcgtggcccgaagacggcaataatccttcgacctcgagttcttcgcagcgcaatcagcagcaggcgcatgcgccccgagctgtttctgggcacgctgcaagtcatccaagtgctagcaatatctttaaactcctagtgcaaagagaggtctctccacggtcaaaacattcatcaaagaaattgtggagagaagcttcaaagtgccagccctatccattccagcaaagttgtgaagcagtgagagatgtgagacagggtctcatatcatgggtggagtcagcgtcactgcggcatttgtctgccaaatattgtccacttgtgcctcctccaagatcaacaattgcagctgcctttagtcctgatggaaaaatacttgcttctacacatggagatcatacggtgaaactcattgattctcagacaggaagttgcttgaaggtgttaaggggtcatcggaggacaccatgggtggtgagattccatccgctgtatccggagatccttgcaagtggcagtctggatcatgaagttcgcctgtgggatgcaaataccgcagagtgcataggatcacgcaatttttaccgtcctattgcatcaattgcattccatgctcgaggagagcttcttgctgttgcatctggtcacaagttgtacatatggcactacaataggagaggagagacatcatccccaactatcgttctgaggacacagcgatctcttagagccgtgcatttccacccacatgcagctccatttcttttaacagctgaggtcaatgaccttgactcagcagattcagctatgactcttgcaacttctcctggttatttgcactaccctcctcctactgtatattttgcagatgctcattctcatgaaagatctaggttggcggatgaactgcctctcatgcctttgccattattgatgtggccttcctttactagagacgatggaagagtacccttgcagcgcatagatggggatgttggtcttaatggacagcaaagggtagattcatcttcttcagtgcgcctttggacatattcaaccccatcagggcagtatgagctccttctgtctccagttgaaagtggcaactctccttccatgcctgaggaaacgggaaataatgctttctcaagtgcagtggaagctgaagtaagtcaatctgcaatggatactgtggaggatatggaagtgcaacctgaagagagaaatactcaatttttctcttttagcgaccccagattttgggagctgcctttattgcatggatggttggttggtcagacccaagctggtccacgaagtgtacgtcaatcaagtcctggagatattgaaactcaatctgcttttggtgaggttgcaagtgtttcaccaatcacatctggagtgatgccagttagcatggacccgtcacggtttggtggaagatctggttctagatatcgctctcctgggtctcggggggtgcacgtgactggacctaataatgatggaccacgagatgaaaacgatcctcaatctgttgttagtaaactcaggtctgaacttgcagcctcgctggctgcagcagcatctacggagttaccctgcactgtgaagcttagaatatggccacacgacgtaaaagatccttgtgcacagcttgatttagaaagttgccgcttaactattccacatgctgttctatgcagtgaaatgggagcccatttttctccatgtgggagatttttagctgcctgtgtggcatgtgtgctgcctcatttggaatctgatcccggattacatggtcaagtcaatcaggatgtcacaggagtggcaacctcacctacaagacacccaatttctgctcatcaaatcatgtatgagctaaggatatattccttagaggaggcaacatttggaattgtgcttgcttcacgaccagtaagagccgctcattgtttaacctccattcagttctctccgacatctgaacacttgttacttgcctacggccgtcgccatagttcacttcttaagagtattgtcattgatggagagaatacggtgcctatttacaccattttggaggtatacagagtttctgacatggaacttgtgagagttcttccaagtgcagaggatgaagtcaatgttgcatgctttcacccttcagttggaggtggcctcatttatggaacgaaggaaggcaagttgaggattctccactatgacagctctcatggcttgaatctaaagtcatctggttttcttgatgaaaatgtgccagaggtgcagacttatgctttggaatgttagtagccagcaactgcaacatgtttgtgatacttactggtcaacctcaaagatcttgggtcgagggcagctgtacctatatcttcacaactgtagacccatctgcggccaggctcgtggttcctcaatcaattactagttaaacgcaattctgtaccaactaccattctttgctgtttgtggggatttatgttatcaactgcaagagcattaggaagttcatctaacttgagatagatgggttagtgcgagttggaaatgtcgggattcgtgttgtatatttgtttgtccgctttgatatttacggacttttgtaaaaaaaaaa

SEQ ID NO: 82 - DNA, 2094 bp, Eucalyptus sp.
cgaagtaaacctctcggaacctgaatctgctctcaaaatctcgtcggtgccggagaaagtttccccgatcgatcgcctcctccgccgaggagcgcatggattccgccgtcgcgatcgcggcgctgtcgctcgtggtcggagccgcgatcgccctccttttcttcggcaattacttccgcaagcgaagatccgaggtcgtggccatggccgaggcggacctccagccgcatcccaagaacccgtcgcggcctccgccgcagcccgccgccaagaaggtccacgccaagtcccatgctcacggcgccgataaggataaaaacaagaggcatcatcctttggatctgaatactttaaaaggtcacggggattcagtcacagggctatgtttcgcttctgatggacgaagtttggcaacagcttgtgctgatggtgttgtgagggtgttcaagttggacgatgcctcaaacaaaagtttcaaatttctgaggattaacttgcctgctggaggccatccaactgctgttgcatttggtgatggtgtatcatcagtaattgtggcatctcaacatttgtctggttgttctctgtacatgtatggagaagagaagcctacaaatttggacagcaataagcagcagactaagctacctatgcctgaaatcaagtgggagcatcacaaagttcatgagcagaaagcaatattgaccctttctggggctgctgcaaattatgacagcggtgatgggagtacaataattgcatcttgttcagaaggaactgacatcataatttggcatgcaaaaactgggaagattttggggaatgtcgatacaaatcaattgaaaaacactatgtctgctatctcacccaatgggcgatttattgctgctgctgcttttactgctgatgttaaggtctgggagattgtttactcaaaagatggttctgtgaagggagttacaaaagtcatgcagcttaagggacacaagagtgcagtgacttggttatgcttcactccaaactcagaacaaatagttacagcatcaaaggatggctctataagaatttggaacatcaacgttcgataccaccttgatgaggatacgaagactttaaaggtgtttccaatcccattgcaagattcaagtggtactactttacactatgagcgcctcagtctatcccctgatggaaagatactggcagcaacccatggttcaatgttgcagtggctgtgcattgaaactggaaaggttttggacacagctgaaaaagctcatgacggtgacatcacttgcatgtcctgggcaccacagagtattccaacaggcgataaaaaagttaatgttttggcgacggccagtggtgataaaaaagtgaagctttgggcagccccaccacttccctcatagatgagttaatacaggaggctgaaattcagcatcagaacaatgtgaagcttgctcctacgaatacgctttgccatttgagatgcattatggggttctaaattatatctgagccactgtcactcttcacaagaaagcctcagagtgtcctatggaacgttccaacactgtccattctgacagcatccggacatacagttcatacttcgacgttgttagcctttccttaaaaaattttgccgataaacttggcctaatgcagaatccaacaggaagagttttctgtattccttctgtttatttgtcttctctttggagggatattgagaaggttgttgttgagatggtggctgaactgcgaggcgatgacccagtataatctatctgagccggactgatctggacggctcaatcaagtgcttttccttttaatttgcttgctttttgggacaggctattacactttcaaatttgcttgtgtggctgaagcaccatattctactaagttagtcagcctcagagtgggaggacgaacctatgcggatgcgcattggcaaatctgaacaatcattctgtagaacactagagtctatatgcttgactgtatcggttaattaattcaagatgaccacgatatgttgttgcacatgtgatcgtcaaaactggtcgttcttcaaaaaaaaaa

SEQ ID NO: 83 - DNA, 2116 bp, Eucalyptus sp.
agaagaggccacctaaaaccctagaagccagagactgcaaacctcataaaacctccaaagcgcgcaccaagaaaccccccgcagaagaagagcgcgagctttcgcattcgcatcaatggaggtggaacccaagaaggcgtccaagaccttcccggtgaagccgaagctgaagccgaagccgagaaccccttctggcaagaccccagaatccaagtactggtcctccttcaagaccacccaccccctcgacaacctctccttctccgtcccttccctcgccttctccccttcccctccccacctcctcgccgccgcccactccgccaccgtctccctcttctccccccaccgcaccaccatctcctccttctccgacgtcgtctcctccctctccttccgctccgacggccaactcctcgccgcctccgacctctccggcctcatccaggtcttcgacgtccgctcccgcaccccgctccgccgcctccgctcccacgcccgccctgtcaggttcgtccgctacccggtcctcgacaagctccacctggtgtccgggggcgatgacgccctcgtcaagtactgggacgtggctggggagagcgtggtgtcggagcttagagggcataaggactacgtccggtgcggggactgttcgcccgccgacgcgaattgcttcgtcaccgggtcttatgatcacgtggtgaagctctgggatgtgagggtgagagatgggaacagggcggcgacggaggtgaatcacgggtcgccggtgcaggatgtgatcttcttgccgtcggggagtttggtcgccactgcgggagggaatagcgtgaagatttgggacttgattggaggagggaggatggtttattcgatggagagtcacaacaagaccgtgacctccatttgtgtgggtacgatgggggcgcagcagagcggggaagaaggtgtgcagctgaggatcttgagcgttggtcttgacgggtatatgaaggtgtttgattattctagaatgaaggtcacacattcgatgaggttcccggcacctctgctgtcgatcgggttttcgccagatagcaacgtgagagccattgggacttcgaatggtattttgtatgtgggaaagagaaaggcgaaggaaaatgcggagggtggtgccaatggaatcttagggttgggcagtgtggaggagccgcggaggcgggtcttgaagccctcgttctataggtacttccacagaggtcagagtgagaagccatccgagggagattatttggttatgaggccgaagaaggtgaagttggctgagcatgataaactcttgaagaagttccagcataagaatgctctcatttcagttttaggtggaaatgatcctgaaaaggtggtggctgtgatggaggaattggtggctcggagggcactgctaaagtgcgtcctgaacttggatgcggatgaattgggtctgattttgacgttcttgcataagaactcgactgtgcctagatattcaagcttgttgctggggctggcgaagaaggttattgacttgaggctcgaagacataagagcatccgatgccttgaagggtcatattaggaacctcaagcgctcagttgatgaggagattcggatacaagaggggttgcaagagattcagggtatggtatctcctttactaaggattgcaggcagaagatagcgatagagttatactgcatgtactgaggtaaatgttttgattactccacccaattgcgttggttctctactttttccccttgagggatgaaatatgaggagattcggatacaagaggggttgcaagagattcagggtatggtatctcctttactaaggattgcaggcagaagatagcgatagagttatactgcatgtactgaggtaaatgttttgattactccacccaattgcgttggttctctactttttccccttgagggatgaaattttgctgcaatgtatgagtttcactaaatttatggaacacttatgtttttatacggagatggttggagttgaaggtccatcttccgggttttatctgtaactggatgctcaagtaaaacaattttttttccctttaaaaaaaaaa

SEQ ID NO: 84 - DNA, 1467 bp, Eucalyptus sp.
cgagttcagctcaagcgccatctccgatcgccggtcaccgcatcgatgcagggaggatcgtcgggcgtcggctatggcctcaagtaccaggccaggtgcatctccgacgtgaaggccgacaccgaccacaccagcttcctcaccggaaccctcagcctcaaagaagagaacgaggtccatttgctgaggctctcgtcgggcggcacggagctgatctgcgagggcttgttctcgcacccgagcgagatttgggacctctcttcctgtcccttcgatcagcgcatcttctctactgttttctccaccggtgaatcttatggagctgctgtgtggcagattcctgagttatatggacagttaaattctcctcagttggaaaaaattgcctcgcttgatgctcattcacgcaagatcagttgtgttctttggtggccgtctggaaggcatgacaagttggttagcattgatgaggaaaacatcttcttatggggtttagattgttcgaaaaagtcggctcaggtccaatcacaggagtctgctggcatgctgcacaacctctctggtggagcgtgggatccacatgatgtaaatactgtcgctgcaacctgtgaatcatcaatccaattttgggatcttcggactatgaagaaagcaaattcactagaatctgtccatgctcgtgacctagactatgacatgcgaaagaagcacttacttgttacctccgaggatgaatctggtgtacgtgtatgggatcttagaatgcctaaagctcctattcaagagtttcctggtcacacacactggacttgggctgttaggtgtaatcctgattacgaaggactgattctgagtgcaggtacagactcagctgtaaatttgtggtggtcatctactgcgagcagtgatgagctgatatctgagaggctaattgactcgcctaccagaaagcttgatccattgctccattcatacaatgactatgaagacagtgtttatggcctggcatggagttcacgagaaccttggatatttgcatcgttgtcatacgatgggagggtggttgtagaatcagtgaagcccttcctgtccagaaaatgacttcagggacactaaattaggttcattgcccctttgcggtcctggcctttttacatttggagatgctacgaagtatttcttcttgctttttcggttggttggggacttataaattctcattatagatttttttctccaatcattgattttgaacaaggtatggttgagagatcatgtttcttcttcccagccctggaaagctgttttatctttggatcattcgagtgaaacttccaaccgattaaggcaagaattgttaggaggtgtatactttctgtaactgtattcaatgagcatacacctgacggaaaaaaaaaaatcatcgaatcactgtaaaacttccttcacaaatttttaaaaaaaaaa

SEQ ID NO: 85 - DNA, 1454 bp, Eucalyptus sp.
gggagagagagaatccaggtccatggcggaagaggagggaagcgcggagctggagcagcagctggaggaagagttcgcggtgtggaagaagaacaccccgatcctctacgacctcctcatctcccacgccctcgagtggccctccctcaccgtccactgggcccccctccttccccagccctcctcctccgccgccgccgccgccggcgacccttccctcgccgcccaccgcctcgtcctcggcacccacacctccgacggcgcccccaacttcctcatcctcgccgacgccctcctcccttcttccgaatccgatcattgcggcgacgacgccgtgctccccaaggtggagatatcgcagaagattcgcgtggatggggaagtgaatagggcgcgtttcatgccacaaaatcacaatattgtgggcgctaagacaaatggttgcgaggtttatgtttttgattgttctaagcaggctgcgaagcagcacgatggtgggtttgatccggatttgaggttgacgggtcatgatggagaaggctatggattgtcctggagccccctgaaagaaaactaccttttaagcgcgtcccatgataaaaaaatttgtctctgggatatatctgctgccgctcaggataaagtgctcggtgcaatgcatgttttcgaggctcacgagggtgcggtcggcgatgcatcttggcactcgaagaatgacaacttatttgggtctgctggtgatgattgtcaattgatgatctgggacttgcgaacgaataaagcacaacaatgtgtcaaagcacatgagaaagaggtgaattctgtatctttcaactcatataatgactggattctggcaaccgcgtcttcagacacaacagttggactatttgacatgcggaagctgaccacgccattgcatgtctttagtagccatgaaggagaggtcttgcaagtagaatgggatcctaatcacgaggctgtgttagcttcttcctcagaggacagaagggtgatggtctgggacctcaacaggatcggagatgaacagcaagaaggagatgcaagtgatggccctgccgaactgctcttttctcatgggggtcataaagctaagatctcagatttctcatggaacaaaaacgaaccatgggttatctcaagtgtggctgaagacaactctgttcaggtttggcaaatggctgagagtatctgtggagatgacgacgacatgcaggccatggaaggatatatatgagatttggtacaattgcttcatcgaaatttctcgctctggctttgtttcggggccaacagagaatttttgctgaatttactaattctacaatgcttcacgaagcattttctttcagtccttttagcagctaagatggaagataaactcactggcatgatccgtttggtgtaaatcagcttatttgcgaaaaaaaaaa

SEQ ID NO: 86 - DNA, 2836 bp, Eucalyptus sp.
agagagggagacttccaccaaaaggacaaactagaagaatcacctcctccaacctccgggaccttaccttctcctccctcctccttgagagcaccatcgctattatcgaggccatttttttcgtttgcctcttttccaattcgtcttctctctctctctctctctctctctgtgttctttttttatatgtttaaatctcgccttcatttttatcccactgtaatggattccttgcttcctcatgcgggacttcggtagacagaggagggagagggagagagggagagggagcggggtggaattttcaggagtggaaatccccagggccgtttcgatttctgggtttcgacccgaatcccatttttgatttccaggttcgtatgggttgaaagctaaaagggtcatggggaattacggtgaagaggacgaggatcagtattttgatgccctggaggagacggcctctgtttcagatcggggttcaaacagctctgattgttgtagttcaggttccgggcttgatgagaacgttttggatagtttagggttcgagttttggactaaatttcccgagagcgtgagggcgcgccgcaatcggttcttgatgttgacggggttgggaatagaggcaaattcagtggacaaggaggatgcattcccgccatcttgtaacgaaatcgaggtgtatacgtgtaaagtaacaagagatgatggggcggttcaaagatctttggattcatataattgtatttcactgttgcagtcatccacatccattcggtcgaatcaagaagttgaatcattgcgtggggactcgctcctcagcagtttcaggggtagaagtaaggagtctgatgatttgacggaattgtgtgggatgggttgtccagagtcaaagagaaatgcggtgagtgaatttggttcagtaagtcagggaagcattgaagaactgaggagaatagttgcatcttctcctttggttcatccgctgttgcataggaaattagagtatgaaagggaattgattgaaaccaaacaaaaaatgggagctggttggttgaggaaatttggctctgccacatgcattagtggaagacagggtgacacatggtcagaccctgatgatcttgaaataacggcagggatgaaaatgcggagagttcgtgcacattcatctaagaagaaatacaaggaattgtcttccctttatgctgcacaggaatttctggcacatgaggggtcaatttcgacaatgaagttcagtatggatgggcaatacttggcaagtgcaggtgaagacacagtagtgagagtttggaaggtgactgaggaggatagatcagagagggtcaacgttactgtggacccttcctgtttatattttgctctgaatgaatccacgcagttggcgtcgctcaatacgaataaagagcacattggtaaagcaaaaacatttcagagatcatcagactcatcgtgtgtcattttacccttaaaggtcttccagataacagagaagccttggcacgagttcaagggacataatggcgaggtcttagacctctcctggtctagtaaagggtatttgctatcctcctctactgataagaccgtgcggttgtggagggttggatgtgatagatgccagagagtatattctcacaatgattatgttacttgtataagtttcaaccctgttaatgagaacttcttcatcagcgggtccatagatggaaaagtacgcatctggaatgtgtttggtggtcaggttgttgcttacatcgattgtagggagattgtctctgcagtgtgctatcgatccgatggaaagggagccatcgtgggtaccatgacaggcaattgccttttttatagtattaaagataatcatttgcaaatggatgcacaagtatacctacatggtaagaagaagtctcctggcaagagaataactggctttcagtttcctcccaatgatcctggcaaactaatgatcacatctgctgattctgtaattcgagtattaagcgggctagatgtagtctgcaaactcaaaggccctcgaaattcagggggaccaatgattgccactttcacttcagacgggaaacacgtgatctcagcaagtgaagattcaaatgtctacatctggaactacgccggtcaggacaagacttcatcccgggtgaagaagatatggtcttgcgagagtttctggtccagcaatgcctctgttgctttaccctggtgcggcataagaactgtgcctgaagcacttgcacctccttcacgaagtgaagagagaagagcgagttgtgcagaaaacggggagaatcatcatatgctggaggaatatttccagaaaatgcccccatattccccggactgtttctctctcagccgcggattcttcctggagctcttgccgaagggatccgcgacttggccggaggagaaattatctgatactagcccacctacggtctcatctcaagcaatttctaaactggagtacaagttcctgaagagcgcgtgccacagcgtgttgagttctgctcacatgtggggcctggtgatcgtgactgcaggttgggacggaaggatcaggacatatcacaactatggattacctgtacgttcttgaaatcccgattcactaaaattatgaaggcggtgagttcagtcgtccgccttttcttagttttaccctacgaatacatggtgatgctcacgctcaaggggggtttgcctcaagtgtaaaaggatgcccctaatagattatatgccaagtgtagtatatataatagtgcttttgtcacacaccaaaaaaaaaaaa

SEQ ID NO: 87 - DNA, 2760 bp, Eucalyptus sp.
gaagaagtaaagccttgacgctggtttttggtcagctccgtttccctcactcatcaactctctccttctctctctctctctctctctctctctctctccgtgcgccatggacatcgacttcaaggagtaccgacttcgctgcgagctgcgcggccacgaggacgatgtccggggcgtatgcgtgtgcggggacggcagcatcgggacctcgtcgcgggatcggacggtgaggctgtgggctccgagcgccggcgagaggcgcaagtacgaggtggcgagggtgctgttagggcacaagagcttcgtgggtcccctggcgtgggttccgcccagcgaggagcttccggagggcgggatcgtgtccggcgggatggacactctcgtgatggcttgggatttgaggaatggagaggcgcagacgttgaagggccatcagttgcaggtcaccggcatcgtgttggacggcggcgacattgtttctgcctctgttgattgtaccttaataagatggaagaatggccagcttacggagcactgggaggctcataaggcccccatacaagcagtcataaggttgccctccggggagcttgttacaggttcaagtgacacaaccttaaaactctggagaggaaagacgtgcactcagacttttgttgggcatacagataccgttcgaggcttggcagtgatgcctgatctgggcattctatctgcatcacatgatgggtctatcaggttatgggcagtgagcggtgaatgtctaatggagatggttgatcatacttctatagtctattctgttgattcacatgcttcgggcctcatagtcagtggtagtgaagatcgttttgccaaaatatggaaagatggagtttgctttcagagcattgagcatcctggttgtgtgtgggacgtcaaatttttggaagatggagacatcgtgacagcatgttctgatgggaccatacgtatatggacaaatcaagaagataggatggctaactcaactgagctcgagttatttgatttagaactatcttcttacaagagaagcaggaaaagggttggaggactgaaattggaagagttgcccgggttagaggctttacaagtgccaggaactagtgatggccagacaaaagtaatcagagaaggagacaatggggtggcatatgcatggaattcaactgaactaaaatgggataagattggtgaagtagttgatggaccagaagatagcatgaaccgcccagccttagatggtgttcaatatgattatgtatttgatgttgatattggagatggtgagcctacacgtaagttgccctacaatcgatcagataatccatacgacactgccgataagtggcttctcaaggagaaccttcctctttcctatcgccaacagatagtggagtttatacttgcaaattctgggcagagggacttcaatcttgatccatcatttcgtgatccctatactggttccagtgcatatgttcccggcgcaccttcacagctggcagctaaacaagcgagacctactttcaagcatatacccaagaaaggaatgctggtctttgatgcggctcagtttgatggaattcttaaaaagatcaatgagtttaataatactttgctctctaatcaggaaaagaagaacttatcattgacagatatagagatttccagattgggagcagttgtcaaaattttaaaggacacgtcacattatcattctagcaaatttgccgatgctgactttgatttgatgttgaagttgctagaatcatggccatatgaaatgatgtttcctgttattgatattttcaggatggtaatcctgcatccagatggggcagatggacttctgaggcatcaagaggacaagaaggatgttcttatggaatcaatcaagagagctactggaaatccttcagttcctgcaaatttcttaactagcatccgggctgtgactaatctattcaagaattcagcatactacagctggttgcagaagcatcgtagtgagatgcttgatgcgttttcgagctgctcttcttcttcaaacaagaatctacagttgtcttatgctactctattactcaattatgctgtgctattgattgagaagaaggatgaagaaggtcaatctcaagttctttcagcagcacttgagcttgcagaaaatgaatctttagaagttgatgccagatatcgagctttagtagctattggatcattgatgcttgatggtcttgttaaaagaatcgctttggattttgatgttgagcacattgccaaagctgcaaggacttctaaagaagccaagattgctgaagtaggagcagatatcgaactccttataaagcagagttgaatgactgttatttgagctgtgcaaatattcaaccgctcgtgattccgtcgtgggactgcacacctgttatacagaagtctttcagaacagcattcatgctaccgtggaggaacaatgggtcacttggattgagagatggccacatttggaaggcattgattggccttaaagtatcattgttgggaatcgtatactgtgtaggagattacatgataacagattgagattgcacaggtctacgattttctttctgccagcaaaagctgagacttttgtatggactaaaaactcgccataagaagcatggaaacgcgggggggcggaaaaccagtgccgtgtgccctgcaatgcatacgtctttcactgtaaaaaaaaaa

SEQ ID NO: 88 - DNA, 1928 bp, Eucalyptus sp.
caaaagttgcagcttcctgcaaatggaatggccgaatcagctgcgaggaagcaagctctcgcggccaccttcgatgcatcagaccgagccgtagtcggagatccactcgcctccgacacctcccggcacgcctcgattctcctcgcgtgcccccgatcccctcttcaatcgtgaatcgggagctcgggaacttgctcttccttcgtctgttgccgcgtgattcggggttgcgtttcagcggaatggagttcacggaagcgtacaagcagtcgggcccttgctgcttctctcccaacgcgcgcttcattgccgtcgctgtcgattatcgcctcgtcatacgcgacacattgtcgctcaaggttgtgcagttgttttcatgcttggataaaataagctacatagaatgggcccttgattctgaatacatactttgtggtctctataaaagaccaatgatacaggcatggtcattaattcaacctgaatggacatgtaaaatagatgaaggtccagctggcattgcttatgctaggtggagcccggatagtcggcacatactgacaacatctgatttccaactccgcttgacagtttggtcattggtcaacacagcatgtgtacacgtgcagtggccaaagcatgcttccaagggggtgtctttcactcgagatggaaagttcgctgcaatatgcacaagacatgattgcaaggactacatcaatctgctttcttgtcataattgggagataatgggtgtttttgctgttgatactttagacttagctgatatccagtggtcaccggatgatagtgctatagtgatatgggattcacctcttgaatacaaggttttggtatactcaccagatggtaggtgtctgtttaagtatcaagcctatgaaagtggattgggagtgaaaagcgtttcttggtctccttgtggacaatttctagccgttggtagctatgaccagatgttaagggtcttgagccaccttacttggaaaacttttgcagaattcacgcatctatctaatgttcgtgctccatgttgtgctgccatctttaaggaggtggatgagcccttgcaaattgacatgtctgaattgtctttaagtgatgattatatgcaaggcaattctggagatgctccagagggacattacagagtcagatatgatgttacagaagttccaattactttgccttgccagaagcctccagcggacagaccgaatcccaaacaaggaattggtctgatgtcatggagcaatgacagccagtatatatgcactcgcaatgatagtatgccgaccattctttggatctgggacatgcgccatcttgaacttgctgccatcttggttcaaaaggatcctatccgagctgcagtttgggaccctacaggcactcgcctagtcctttgcacaggaagctcgcacctgtacatgtggactccttcaggtgcctactgtgtcagcgtccccctatctcagtttaatataacagatttgaagtggaattcggatgggagctgtcttttgctcaaggacaaggagtcattttgctgtgctgcagcaccactgccaccagacgaatctagtgattatagctcagatgattgaggcatcgatgtgtactctccagagtgacatggactgcaaactgcagttgttcgtaggactgtatatttaggcatgttagatccaccggatagagaatagagattgactttttggtgttgtataattctttacagttgggatgattagcttctgggaggtaaattgatgacaatcgattggccgctcctcatcttttccttttgaactgtagaaagccggacttttgggtaatggtcaatctgtttgcctgtgttcgatagaagggcaaaaatctgtacgctgatatgaatcgcggtgagagcc

SEQ ID NO: 89 - DNA, 1344 bp, Eucalyptus sp.
gtcacctcgaagtgctgcgctcaaactaaactcccccaggccaccgtcgccgcgtctcctctcgttcgctcgcgcggggggcgcccaccagagcagccgcggaagaacgcgatcgatcgacggcgatggcaacgatcgcggcgcttgacgacgacatggtccgcagcatgtcgatcggagccgttttctccgacttcgttgggaaattaaattcgcttgattttcaccgtaaggatgatattttggtcacggccggcgaggatgattcagtgagattgtatgatattgcaaatgccaggttgctcaagaccacctttcacaagaaacatggcactgatcgtgtgtgctttactcatcatccaaactccctcatatgctcttcaaccaaaaacttagatactggagagtccttaagatatatatcaatgtatgataaccgaagcctccgctactttaagggacacaaacagagagttgtttccctgtgcatgtctccaatcaatgatagcttcatgtcaggctctcttgaccacagcgtgagaatgtgggatctccgtgtgaatgcttgccagggaattctgcgtctacgtggcagacctactgttgcatatgaccagcagggtcttgtctttgctgtagctatggaagggggtgctatcaaattgtttgattcacgctcttacgacaagggcccctttgatgcctttttagttggtggagatacatctgaggtctgtgatatcaagttcagcaatgatggaaaatcagtgctattatcaaccacaaacaacaacatctatgttctcgatgcatatgcaggagataagcaatgtggattcaatttagaaccatctccaagtacaccgatagaggcaagtttttcaccagatggccagtacgttgtatcaggctcaggagatggaactttgcatgcatggaatatcagcaggcgaaatgaggtagcatgttggaatagccatattggcgtcgcatcatgcttgaaatgggctcctcgtcgggccatgttcgtagcggcatctactgtcctcactttctggattccaaattccgagcccgagcttgcttctgccaaaggcgaggccggagttccaccagaacaagtataactgtgaagcctccatttacagctctagaccctgccatgagcttctttaagcgagcaatagagttaataatatgttgtaaatcttctcatgtgcctggcgtaaattttgcagttattactagaccaagatagtttcatgctccacagaacaaattgacacccccacctgtactttaaagtcacaattttcaaaagcttctgttttcttaaaaaaaaaa

SEQ ID NO: 90 - DNA, 1676 bp, Eucalyptus sp.
gcttcgtcgagctgtccagacgcgtcccaaaatcagttgctctcgattctcctcccgcgatctccttcccttccttcccttcccccgtctgtacatctcgaagccctaacctccgaagctccttccgatgcaccgccgccaccgccgccgtcatcaccgccgcgactgctcccgccgatgagccgagccgggcgatgacggctcctgcctaggggaagagggaaacactctcgcgcgcgcgcccccgacgacgacgatgtccgtggcggagctgaaggagcgccacagggccgcgaccgagaccgtcaattctctccgggagcgcctcaagcagaagcgagtgcagctgctcgacaccgacgtggccgggtacgcgaggactcaggggaaaactccggtcacttttggggcgacggatctggtgtgctgcaggaccttgcagggccacactggcaaggtgtactcactagattggactcctgaaaggaatcgcattgtcagcgtgtctcaagatgggagatttatagtgtggaatgctctgaccagtcagaaaactcatgccataaggcttccttgtgcatgggtaatgacatgtgcttttgcaccgaatggtcagtctgttgcctgtggcggtcttgacagcgtatgctctatcttcaacctcaattcccccgttgacagggatgggaacctaccggtatcaagaatgctcagtgggcataaaggttatgtgtcatcatgtcagtatgtaccagacggagatgctcacctgattacaggatctggtgaccaaacatgtgtcttgtgggatattaccacgggtctgagaacttctgtctttggaggagaatttcaatcagggcacactgctgatgttttaagtgtgtcaatcaatggatcgagcccaagaatatttgtttctggttcatgtgattcaactgctaggatgtgggatactcgtgttgcaagtcgagccgttcatacatatcatggacatgaaggcgatgtaaatgccgtaaagttctttccagatggaaatagatttggaactgggtctgatgacggtacttgcaggctctttgacatcagaacagggcatgaacttcaagtgtactatcaacagcgtggcatcgatgagatcccacatgtcacctccattgcattttccatttcggggaggctgctaattgctggatactcaaatggtgactgctttgtgtgggatacattattggcccaggttgtgttgaacttgggatcgttgcagaactcacacgaaggtcggatcagctgtttgggtgtgtctgctgatggaagtgccttgtgtactggcagttgggatacaaacctaaagatttgggcttttggagggattcggagggtgacttaatttctgcaggagccgaaccctttgatttcttcgaggtctctcatttcatgttactgcgtccgtttcgttacatgcccataatttgtggaaaaatagattgagaagccctatcctgtaattgcatcgctgtcattctcatgatgaaaaagaaaatgacatggattcgatcaatcgccacatgacaactaaaacaagcggttcacgtgattgtaattttatcctcattgcttctgtgtgcttgctttgttcctaacgtcattctcatgaacgtcttgtaaaaaaaaaa

SEQ ID NO: 91 - DNA, 1860 bp, Eucalyptus sp.
gcggcgagagcatcgagcactgactctctctctctctctctctctctctctctctctcctcttcttcatcacttgttcgactcggattggtcgatcagccctcccgtcgcgccgccgaccgtccctcgctcccctccgttcgcgcgctccaccggctgatcgggtcgtcccgcggggatgaagaagaggccgagaggagcaagcctcgatcaggcggtcgtcgatatacggcggcgagaggtcggcggcctctccggtctgagcttcgctcgccgcctcgccgcttccgagggtcttgtgttgaggctcgatatctataataaactgaaagggcataggggatgtgtcaacactgtcggtttcaatcttgatggtgacatagtaatatcgggctcggacgacaggcatgtgaagctctgggattggcaaaccgggaaagtcaagttgtcattcgattcgggtcatctaagcaatgtcttccaagccaagatcatgccatacactgatgataggagcattgtcacttgtgcagctgatggacaggcaaggcatgctcagattctggaggggggacaagttcagacaatgttgttagccaagcatcggggaagggctcataagttggctatagatcctggaagtccgcatatagtttacacatgtggtgaagatggattagttcaacgtcttgatctcaggagtaatactgccagagaacttttcacttgccgagaagtatatgggactcatgtggaagttgttcatttgaatgcaattgcaatcgatccaaggaacccaaatctatttgtgattggtgggtcagatgagtatgctcgggtgtatgatattcgcaattacaagtggaatggatcgcataattttggtcgatctgctaactacttttgtccttctcatctcattggtgaggcgcatgtgggaataacaggcttagccttctctggtcagagtgaactcctcgtctcttacaatgatgaatccatctatctcttcacccaggagatgggactgggtcctgatccgctctctgcctccaccaagtccgtggacagtaattccagtgaggtgacatctcccacagctgtgaatgttgatgacaatgttacccctcaagtctacaaagggcacaggaactgtgagacagtgaagggtgttggcttttttgggcctaaatgtgaatatgtggtgagcgggtctgactgtggccgcatattcatttggaagaaaaaagggggacagcttatccgtgtcatggcagctgataaacacgttgtaaactgtattgagcctcatcctcatatccctgctctggctagtagcggaatagaaaatgacatcaaaatctggactcccaaggctattgaaagagctactctaccaatgaatgtcgaacagctaaagccaaaggctagggggtggatgaacagaatatcgtcgccccggcaactgttgttgcagctatattccctggaaaggtggccggagcacggtggagagacttcatctggcttggctgctgggcaggaggaactcacggaactctttttcgcactgagcgctaacggcaacgggtctccggatggtggtggtgatccttctggtccactcctttaggcgactgatgtggtgcgttcagaagacgactagcaactgtgcataataatgtagggcaaaaccgttttgcttccccatccacactctttttttctgtttcttcttcggctttcttcggcttctcttcctcctcttcatggatgtatatgttcatccacataacttgttcatgcttgtttatattcttttatttatttttctcctccttttcatggattaaaaaaaaaa

SEQ ID NO: 92 - DNA, 4170 bp, Eucalyptus sp.
gaagactgtcttcctcaagaaaaagcaaagcggggaatcaagaaagcaaggccttcccgttcttggccagcactgtcgaaatctcacgcgcgaatttctcgcgaatccgtcgtccttccttcgtcccttccgaatctgtgaatccgatccccatctttcgtcttgtccggaagagcgtgagtttgttgttcagagcttccttcgggctggaggaaagtctcgggttccggctgcttaatcttgggggttctgggttctgggttttggctcccgagtggctgggaggaagatgtccaagcggggctacaagctgcaggaatttgtggcccattcgtccaatgtcaactgtctcagtattggaaagaaggcatgccggctttttctcactggtggagatgactgcaaggtcaatctatgggccatcggcaagccgaattccttaatgagcctttgtggtcatacaaatgctgtagagtccgtagcctttgattctgcagaagtgttggtgcttgctggagcttcttctggtgtcattaagctgtgggacgtggaagaagcaaagatggttcgtggtcttactggacacagatccaattgcaccgctatggaattccatccatttggagagttctttgcatctggttccactgacacaaatctgaagatatgggatatcaggaagaagggatgtatacacacgtacaagggtcatactcgaggcattagcaccatcagattctctcctgatggtcgctgggttgtttcagggggaaatgataatgttgtgaaggtgtgggatctaactgctggaaagcttttgcatgattttaagttccatgaaaatcatatccgatctatagatttccatcccttggagttcctacttgctacaggttcggcagatagaacggttaaattctgggacttggaaacgtttgaactaatcggatcttccagacctgaggccgcaggagtacgtgcaattgccttccatcctgatgggaggaccttgttctgtggtttggaggatagcttaaaggtttactcatgggagcctgtaatctgccatgatggtgttgacatgggatggtcaacccttgctgatctttgtattcatgatggaaaactcttgggttgctcatattaccaaagttctgttggtgtttgggtagcggatgcgtcgcttattgaaccgtatggaactaatgtaaagcctcagcagaaggatagtggggatgatgaaattgaacaccaagaaagtcgtccctcggctaaagttgggaccaccataagatcaacttcaatcatgcgctgcgcctctccggattatgaaaccaaagacataaagaatatatatgtggataccgctagtggtaatcctgtttcttcacagcgtgttggtaccacaaactttgcaaaagtgactcaaccgctggattttaacgacactcctaatttgacactacggaggcagggtttggtaacagaaacgccagatggattaagtgggcatgttcctagtaaatctattactcaaccgaaagttgttagtagggacagtcctgatggaaaagactcatctcgaagagaatctattactttttcaaggactaaaccgggcatgttgctcaggcctgctcattcgaggaggccgtcgagcaccaaatatgatgtcgacaggttatcagcatgtgctgaaattggagtgcttagcagtgcaaaaagtggttctgaaagtcttgtagattcatttttgaacatcaaagttgcacctgaagatggagcaagaaatggctgtgaagacaatcattcgagtgtcaagaatgtctctgtggaatctgagaaggtgctaccactgcagacacctaaaacagaaaagtgtgaccaaactgtcggtttcaaagaagaaatcaactctgtcaagtttgtcaatggagttgcagttgtgccaggcaggacacgcactttagttgagaagtttgaaaaaagagaaaaattgaacagcactgaagatcaaacaatcaatacacctgaaaatcccacgttagataaaacccctcctccctctcttgcagagaacgaggaaaagagtgacagattaaacatcgttgaacgaaaggcaacaagaatgtcttctcatatggtaaccgctgaggatagaacacctgttacccttgttggcagtcctgaagatcagtcaactgtaatggctcctcaaagagaattaccagctgatgaatcaagtaaaactcctccattgccggttgaggatttggagattcatcatggatcaaatgtcagtgaagataaggcgactattttgtcttctcagacagtatcagaggaggatagcaaacgctctacccttattcgcaacttccgtagaagagacagatttaaaagtactgaaggtcgatcccctgtaatggctactcaaagaaaactaccaacagatgaatcaggcaaaacttcttctttgccaatggaggatttggaaatcaaaggtggattgaatgtgagtgaagataaggcaactagtttctcttctcgtgcaccaccgagggaggatagagcacactccgctcttgttcgcaatgttcgaaaaagagacaaatttaaaagtactaatgatacaattactgtaatggttcatcaaagaggactatcgacagatgaagcatcaactgtctcagttgagagggttgaaaggagacaattatctaacaatgtggagaacccgctaaataatttgccccctcactcagtacctccaacgaccacgagaggggaacctcaatatgtggggagtgagtcagactctgttaaccatgaggatgtcactgaacttctactgggaaatcatgaagttttcttaagtactctccgttctcgcttgacaaaactacaggtagtttagctctttttgaatgtttacgtggttgagtaaggctaatttgtatattgcatgtccctgtatactttcgttttgaatgttggcctccttacactttggctattcctctaataactagtcttttattccccaccacaatcgtacaacttgccaggtagggttagctaagggttgcaattatgttggcaccatttctaatacttgaaagacatagtattagcagaaagtattgcagtttcagcaaagtgtgatgaccaaatgcttctaaattctaatgcgtaaatctaatcaccaaatggatggttcagaagtcatagaaatggcattttgaccgactatatattacttttcttagctgcatttctacttggtagttgccttgacaattttctcttgtatttccaggtagtcaggcatttctttgaaaggaaagatatgaaaggtgctattaacgcattgaggaggttgccggatcattctgttcaagcagatgtaatcagcatccttacggaaaaaatggagatgctgaacttagatttattttcttgcttgcttcctgtgcttgtgggtttactggatagcaaggtagaaaggcattcatgtgtgtctctcgagatgctactaaagcttgtagcagtttttggttcagtagttcggtcaacagtttctgcacctccgactgttggtgttgatctacatgctgagcaaaggctagagtgctgcaaccagtgttttacagagctgcaaaagatccagaaaattatacctatgcttgtgaggagaggtggtgtaattgcaagaagcgctcaggaattgaatctagtccttcaacagtgctgatggaccataccatctgcatcccttttctgcttacctgcagagtccagttggatgacatctaacagaatactcgtgtacatggacaccgtctgtccttaactcggagtttggctttacggctactgattttgccgcttccatcgatcagttttgcttggtttctcatgaggcaaatgcccgagcactatgcgcatggaaaattaagctcgaagactcaagaggccttgttcggggcatgactccatgatattccgaaagagtaggatctctcaattctttgattctgttgtatggtgtatcttattgtatcttctatctgccccccatgtaattcttcatgtgtacttctcgctcccgtgtaattcatgtgtacttctcgatggtatagtgaaaatccactttgttcaaaaaaaaaa

SEQ ID NO: 93 - DNA, 1525 bp, Eucalyptus sp.
ctggacctcagtagaaagcacgaacccgtcttcttctccctcttcttcttctcctcctccttccatcggcgagcgagagaagacgcagagagagagagagagagagagagagagaatcggaggaacctccatgcgcattggcgaacgatgtccaccttcctgaccggcaccgctctttccaatcccaacccgaacaagtcgtacgaggtcgttcaacctccgaatgactccgtctcgagcctgagcttcaaccccaaggccaacttcttggtggccacttcctgggacaaccaggtcaggtgctgggagattgtgcggagtggaacaagcctcggcactacgccaaaggcatccatatctcatgaccagccagtattgtgctcaacttggaaggatgatggaacaactgtcttttctggcggctgtgacaagcaagtcaaaatgtggccgttgtcaggtggccaaccaatgactgtggccatgcatgacgcgccaataaaagagatttcgtggatacctgaaatgaaccttttagttactggaagttgggacaagacattgagatactgggacacgagacaagccaatccagttcatattcaacaattgcctgagcgttgctatgcccttactgtgagacatcccctcatggttgttggtactgcagataggaatctgataatctacaatttgcaaagtcctcagactgaattcaagagaatcagttcgcccctcaagtatcagaccagatgtctcgctgccttccctgatcaacaaggctttctggttggctctattgaaggaagagttggggtacatcatctagatgattcacaacaaagcaagaatttcaccttcaaatgccacagagagggcagtgagatatactcagtcaattcattgaacttccatcctgtacatcacaccttcgcaactgctggttctgacggcgccttcaatttttgggacaaggatagcaaacagagactgaaggcaatgtcaaggtgcagtcagcccattccctgcagtaccttcaataatgacgggtctattttcgcatactcggcgtgctatgattggagtaagggtgcagagaaccataatcctgcaacagccaaaacttacattttcctgcatttaccacaggaatctgaggttaaaggcaaaccacgactggggactactggaagaaaatgactcctaatttctagtcgcaaagccccatcatcatatttccagttggaagagtcgtattccctgtcggaaggacgagggatttgtacatgtatagactttccagctgcttctcccaaaaaatttagcagttgacctgtttttggccgaagtcaaggatttcgttgtgtagtactgggagttactacttgtatgtatgtaaatcatgtggcgtctgtccagttactatagatgggagtcccctgggtggattttgtgaaatatattttggtgatcggttgtcttttcgttgtatccacaagactacagaaattacatgctaaaaaaaaaa

SEQ ID NO: 94 - DNA, 2131 bp, Eucalyptus sp.
cttccttccctgtcacaagaccctgccttccttctctgtctatctacgcactcctggcatcatcgtatcgattaaagcttcgatttttatcgggattcgaggagaaaagattggatttttgctgctgtgagggaagaagatggaggtggaagcgcagcagcgagacgttaacaacgtgatgtgccaactggtggatccagaaggaacgaccttgggtcctcccatgtaccttccccaggacgttggccctcagcagcttcagcagatggtcaacaaactcctcagtaacgaggacaaattgccgtatactttttacatatcggaccaggagctcgttgtccctcttgaatcttacttacagaaaaacaaagtttctgtggagaaggtgttgtccatagtctatcagccacaagccattttccgaattcgtcctgtaaatcgctgttcagcaacaattgctggtcactcagaagctgttctgtctgtggcctttagtcctgatgggaagcaactggctagtggttcaggagataccacagtccgattgtgggacctaagtactcagaccccgatgtttacatgcaaagggcacaagaattgggtcctctccattgcatggtcgcctgatggcaagcatcttgtaagtggaagcaaggctggggaaatccaatgttgggatccgttgaccgggcaaccatcaggcaatccacttgttggccacaagaaatggatcacaggtatatcttgggaaccagtccatctgagttcaccatgccgtcgctttgtgagttctagtaaagatggtgatgcacgcatatgggatgtaacactaaggagatgtgtaatatgtctgagcggtcacactctagctgttacatgcgtaaagtggggaggagacggtgttatatatactggctctcaggactgtacaatcaaagtctgggaaacttcccaggggaagctgataagggaattgaagggtcatggacattgggttaactcccttgctctgagcactgagtatgttcttcggactggagctttcgatcacactggcaaacagtattcatctgctgaagaaatgaagcaagttgcattagaaaggtacaagaaaatgaaaggcaatgctcctgaaagattggtctctggatctgatgattttaccatgtttttgtgggaaccttctgtcagcaagcacccaaaaacgcgaatgactggtcatcaacagcttgtgaatcatgtctacttttcacccgatgggcaatgggtggctagtgcttcgtttgataaatctgtgaagttgtggaatggtattactgggaagtttgttgctgcattcaggggacatgtcgggcctgtatatcaaataagttggtctgcggatagtagacttcttttaagtgggagcaaagactctactctgaagatctgggatattcgcacaaagaagttgaaacgagatcttccaggtcatgcggatgaggtttttgcggtcgattggagtccagatggtgagaaagtagtttctggtggtaaagataaggtgttgaagctatggatgggttaatgcattgggagttatacaaggcttatcagaccattccatatgcaaatgaaatgagatggcagttcaaatgctttcatccgaagtgaagaattgattgtttgatagcccatattacggctgaagacacaaagtgcacactcaactatcaggtactgcaagttcggatgcaatcagccacaaagtgcgcactcaactatcaggtactggaagttaggatgcaatttggttgcgtaaagccctcttgcatcaggatggtagtcgcagccgatatgcattgtctacttatgatgcagctgatattctcaaaggttttgttaatctaagaaacactgttcaatgctgtgttaattgagagtatcatgagtcaccgatattttgttcatataagtaattggcagaatcagtctttgatattcatatccagttatagtgagcccttcatttttctattggctttatacataatggcagtcaagtatgttggccagagaggagccttcttggattaacccctagcttgagtcattaaatcaatttatcgcacaagtttcaataaaaaaaaaa

SEQ ID NO: 95 - DNA, 2071 bp, Eucalyptus sp.
catctctctctctctctctctctttctctctgtgattgcctgcggatcggctctctgcaggcgcttgaattgtgaagcgcagtctcttgatcgcattttgccagggctctcgcgaagatttcgcgtctccgtgcctctttacttaaagatctgatttttgtctcgaatcacctttgtttgtgttgcagggttccttcttttatttttatattcttttgcgaggtttctatctctcgctccattcgcaaagaactttccctccgccaccgttgcgtaactcgaatagccggattttcgttttcgtttttatttccccgttaattttctgcatatcgcctttcttgtgcttccctttttttttggtgtttgtgtagtatggatgcaggatctgcgcactcttcatcgaatatgaagacgcaatcccgttccccgcttcaagaacagtttctgcagaggaggaattctcgcgaaaacctggacagatttatacccaatcgctcagccatggatttcgattatgcgcactacatgctgaccgaagggaggaaggggaaggagaatccggcggtgagttccccctcaagagaagcctaccggaagcaactggcggaaacgctcaacatgaaccggactcgaatcctggctttcaagaacaaacccccgacccccgtggagttgattccgcatgaactcacttctgctcagccagccaagccaacaaaaacccgccgatacattcctcagacctcggagaggacactggatgctcctgaccttttggacgactactacctcaacttgttggactggggaagcagcaatgtactttcaattgctttggggaatacagtttatctctggaatgcttcggatggctctacctctgaacttgtcacgatcgacgacgaaactggccctgtaaccagtgtcagctgggccccagatggtcgccacattgctgtcggcttgaacaattctgatgtacagctatgggattctgctgataatagactgctaaggactttgagaggcggccacagatctcgggttgggtctctggcatggaacaatcacatccttacaacgggaggaatggatggactgatcgtcaataatgatgtgagagtgagatctcacattgtcgacacctacaggggtcacacccaggaggtttgtgggttgaaatggtcggcatcagggcaacaattagctagtggagggaacgataacatcctccacatctgggacaggtccacggcatcttccaattcacccactcagtggcttcaccgccttgaagagcacactgccgctgttaaagcccttgcctggtgtcctttccaggggaatttgctggcttccggtggaggtggaggtgatcggaccattaagttttggaacacccacaccggtgcgtgcttgaactctgtggatacaggttcccaggtctgtgctctgctatggaacaagaacgagagagagttgcttagctctcatggattcactcagaatcagctcaccctttggaagtacccttcaatggtaaagattgcagagctgactggccatacttccagagtgctattcatggcccagagtccggatggttgcactgtagcatcagcggcaggggatgaaacactgaggttttggaatgtgtttggtgttccggaagtggctaaaccagctccaaaagctaatccggagccttttgctcacttgaatcgcattcgctaaatgaaaagtcatctttgctggttatgtctatcgttttgatcttcaagaatgccaaacaatgggattcacaagtcaagaagatcgccacattgaacaagtattgcgaatagttgaagacaaaatatgcgcctatacaaaaccatagtagcagttgccgtgagtgttcccaagtgtatatttgtacattttatatagtcaaaccataatttttttttccaatggatgtagtcactgatgcgtgacctgccatgtatattttttgtgaactaaaattttgactattgtcactcctcttttagagcaaacaatatgtttttgtagcaaaaaaaaaaaa

SEQ ID NO: 96 - DNA, 1236 bp, Eucalyptus sp.
tactttcttcccctcctgcgtcgctagcagcgcgagagcaagcttccgcaagctttcgattcgctcgcatggaggaggcgatccccttcaagaatctcccaagcagagaataccaaggtcacaagaagaaggtgcattcggtggcctggaactgcacggggacgaagctcgcgtccggctccgtcgatcagaccgctcgcgtctggcacatcgagcctcacggccatggtaaggttaaagatattgaattgaaagggcacacggacagtgtggatcaattatgttgggatccgaagcatgcagatttaattgcaacagcatcaggcgacaagactgtacggctgtgggatgcacgaagtggaaaatgctcgcagcaagcagaactcagtggggaaaacatcaacataacctacaaacctgatggaacacatgtggcagttggtaatagggatgatgagctaacgattttggatgttcggaagtttaagccaattcacaagcggaagttcaattatgaggtaaatgaaatagcatggaacatgtcaggagagatgttctttttgacaacaggaaatggtactgttgaagtactagcatacccatctcttcgacctgttgatacccttatggctcacactgctggttgctattgtattgcaattgacccagttggaaggtattttgctgttggaagtgcagattccttagtgagcctgtgggatatctctgagatgctctgtgtgaggacttttacgaaacttgaatggcccgtaaggacaataagcttcaatcatactggagattacgttgcttctgccagtgaagatctgttcattgacatttcaaatgttcaaactggacggacagtgcaccaaattccatgccgagctgcgatgaacagtgtggaatggaatcctaaatacaatttactcgcatatgctggggatgacaaaaacaagtaccaggcagatgaaggtgttttccggatatttggatttgagagtgcatgagatttcagagcagggcgaaatgattttgcgcatgcacaagagtttccaattttgtgttcgcttaggattttttgtacacattcgaaatctcgtgtatgggacggatctatctttcttgcaaggagttctttgcacgtctgtctatttacgaaggaagagcgtgttctttctttgatcttaccaagaacttatttacttcacaaaacttttttttttaaaaaaaaaa

SEQ ID NO: 97 - DNA, 1625 bp, Eucalyptus sp.
ggctccgtcccgaaaatctcgaaagctttcaaccgtcccccgcctagggtttccacttctcttggcgggaacccgaaaaatcccccgttgaaaatcctcgagagtccagaattccccccggcggcgagcggcggcggcggcggcggcgatggggaaggacgaggaggagatgaggggggagatcgaggagcggctgatcaacgaggagtacaaggtgtggaagaagaacacgccgttcctgtacgacctggtcatcacccacgccctcgagtggccctccctcaccgtcgagtggctccccgaccgggaggagccccccgggaaggactactccgtccagaagctcgtcctcggcacccacacctccgagaacgagcccaactacctcatgctcgcccaggtccagctccccctcgaggacgccgagaacgacgcccgccactacgacgacgaccgcgccgacgtcggcggcttcggctgcgccaacggcaaggttcaaattatacagcaaataaatcatgacggagaggtgaaccgagcccgttacatgccacaaaactcctttatcatagcaaccaagacagttagtgcagaagtttatgtttttgattacagcaagcacccatctaagcctccactagatggtgcgtgcagtcctgacttaaggttgaggggccacagtactgaaggctatggattgtcgtggagtaagttcaagcaaggacacctactcagtggttcagatgatgctcagatatgcttatgggacatcaatgcaactcctaaaaacaagtctctcgatgccatgcaaatcttcaaggttcatgaaggtgttgttgaagatgtcgcgtggcatctcagacatgaatatttatttggttcagttggggatgatcaatacctgctaatatgggatctacggactccatcagtaaccaagcctgtccaatctgtagtggctcatcagagcgaggttaactgtctagcattcaacccctttaatgaatgggttgttgcgacgggttctacagataagactgttaagttatttgatctacgcaagatcagcactgcacttcacacctttgatgctcacaaggaagaagttttccaagttgggtggaatccgaaaaatgagacaatcttagcttcatgctgccttggcagacgacttatggtgtgggatcttagcaggattgatgaagagcagacgccggaggatgctgaagatggaccgcccgagttgcttttcattcatggtggccatacgagtaaaatttcagacttttcatggaacacctgtgaagactgggttgtagccagcgtggctgaagacaacatccttcaaatatggcagatggccgagaatatctaccatgatgaggatgatgttccaggagaagagtccaataaaggatcttgacctaatcattaacaattcagaagtttaggagaaagccgtagtaacttgaacccctatttatctttacctgtacctacgcgcaccattatctttgatcttgcaatgctgtgctagatgatgagtttttactgtctttagaattaccatttgtaaaggattcacttctctttttaattatttttttgaactccgaaaaaaaaaa

SEQ ID NO: 98 - DNA, 2805 bp, Eucalyptus sp.
aaaaataaaagcgacggtttgtgattttcgaacaaaaagtattttggggagacatttccctgaatccctcaacggtttgcctcgcccctgttcggaaaatccgagggaaaaataggttcgaaacctgcgtcgcctcaaagatgggatcgaaccggaatgattagacccttgattagggttctctcacattcgatcccctgaaattatcatcatcatcatcatcatcatcatcaaatcgaatccattttcaggatcattttgagtttcgagttcgatctccattgccgatccgatctcgggaggacgagaagggacgcggcgcaaagatttcggtgcgtgaaggaggttgttccggggacgacaaatgatgaggggcttctcgtgtacggaagatggcgatgcgccttcgacctcgagtacttcgccgccgccgccgccgccgccgccccatcgacagcagatgcaggcgcctcgagcttcttcttcttcttctgggcagccgacgagccggcggagcactggcaatgtctttaaactcttagcacgaagagaggtctctccacgttcaaaacattctttaaagaagttttggggagaagcctcagagtgtcagctctgtcccttccagcaaagttatgaagcagtaagagatgtaagacgaagtctcatctcatgggttgaggcattttcactgcaacatttgtctgccaaatattgcccccttatgcctcctccaagatcaacgattgctgcagcctttagtcctgatgggaaaatacttgcttctacacatggagatcatactgtcaaacttattgattctcagacggggagttgtttaaaggtgttaaggggtcataggaggacaccgtgggtggtaaggttccaccccttgtacccagagatccttgcaagtggtagtttggatcacgaagttcacctgtgggatgcaaatactgcagagtgcataggatctcgcaatttttaccgtcctattgcatccattgcgttccacgcccaaggagatcttcttgctgttgcatctggtcacaagttgtacatttggcactacaatagaagtggagagacatcatcaccaactattgttttgaggacaccacgatctcttagggctgtgcatttccatccacatgcagctccatttcttttaacagctgaggtcaatgaccttgacttgacagattcggctatgaccctggcaacttctcccggttatttgcactaccctcctcctactatatatcttgcagatgctcattctaatgaaagatctaggttggaagatgaactgcctctcatgccttcaccattgttgatgtggccttcctttactagagatgatggaagagcaaccttgccacacataggtggggatgttggtcttagtggacagcagagggtagactcgttgtcttcagggcagtatgaattccatccatctccaattgaacctagcagctctacttccatgcatgaagagatgggaactgatcctttctctagtgtaagggaatctgaagtaactcagtctgcaatgaacattgtggacaatacggaagtgcaacctgaagagagaagtacttatagtttctcttttagcgacccaaggttttgggagctgccttcggtgtatggatggttagttggtcaaacccaagctgcccctcgaactgcaccaagtcctggagctcttgaaactgcatctgctcttggtgaggtagcgagtgtttcacctgtcagatctgaatttatgccaggtggcatggaccagccacggcttggtggaagatctgggtctggatgtcggtcttctgggtctcggatgatgcgcacagctggacttaatgatcacccacatgatgagaactatcctcaatctgttgttagtaaactcaggtcagaacttgaagcctcgctggctgcagcagcatctacagagttgccatgcacggtgaagcttagagtatggccatacgacatgaaagatccttgtgcactttttcgttcagaaagttgccgcttaactattcctcatgcagttctatgcagtgaaatgggcgcccatttttctccttgtggcagattctttgctgcctgtgttgcatgtgtgctacctcagttggaagctgatcctgtattacacggccaggtcgatcccgatgtcactggagtggcaacctcacctactagacaccctgtttctgcttatcaaatcatgtatgagcttcggatttattccttggaggaggcaacatttggaatggtgcttgcatcacgatccataagagctgctcattgtttaacctccattcagttctctccaacatctgaacacttactgctcgcctacggccgtcgacataattcgcttcttaaaagtatagtcattgatggagagaatacagtgcctatttacagtatattggaggtctacagagtttctgatatggaacttgtgagagttcttcccagtgcggaagatgaagtaaatgttgcatgctttcacccttcagttggaggtggcctggtttatggaacaaaggaagggaagttaaggattctccaaattgacagttctgggggcttaaatccaaaatcaactggttttcttgatgaaaacatggcagaggtgcctacatatgctttagaatgctagtagcttggaagtgcaacacgctcgtgaaatttactgctcgaccttgaagcagtcttttgaagcatattatgtcaaaactgggaagaagttcatcaattatgacatctgaggtaaactcaaaaaaaaaa

SEQ ID NO: 99 - DNA, 1262 bp, Eucalyptus sp.
cttcgagagagagagagagagagatgggcgagggcgatctcccccggacggaggcgggcgtgctccggggacacgagggcgcggtgctggccgcccggttcaacggcgacggcaactactgcctcagctgcggcaaggaccgcaccatccgcctctggaacccccaccgcggcatccacatcaagacctacaagtcccacggccgcgaggtccgcgacgtccactgcacctcggacaattcaaagttgatatcttgcggtggtgaccggcagatattctattgggatgtgtcgactggccgagtcattaggagattccgtgggcatgatagcgaggtgaatgcagtaaagtttaacgactatgcatctgtcgtagtatcagccggctatgatcgttcagtgcgtgcttgggattgcagatctcatagcactgagccgattcagattatcaacacgtttcaagacagtgtgatgtctgtttgcttaacaaaaactgaaattattggtggcagcgttgatggtactgttcgaacatttgacattcgtattggtagagaaatatctgacgacttggggcaacctgtcaactgtatttcaatgtcaaatgatggtaactgcatattggcgagttgtttagattcaactttgcgtcttgtagataggtctgccggtgagctattgcaagaatataagggccatacttgcaagtcctacaaattggattgctgtcttactaatactgatgcacatgtggctggtggatctgaggacggttatgtcttcttctgggatttggtcgatgcatcagtgatatccaaatttcgagctcattcctctgtggtaacaagtgtaagttatcatccaaaggaagactgtatgatcactgcctctgtggatggcacaattaaggtgtggaagacatgaaactgttcagctgagcctgagggatcattcctttgtctgagatacgatatagggaattcaccgagtcaattcttaggatatcttgaatcagaccatttgtacttacttttgcctcaggcaatgcatcttttcatgcttcattaggaggtaatatcttttgggtagcaaaactttttgcagaatttcggaagctgaggttcatgtatattatagtctagctcgggaggattgcacttccagcaaatttcttaggggttgtgtaccattgatgggatggattgataatctatgagctgaatgtgcatttcgatttcttgtctgtgccagagaaaaaaaaaa

SEQ ID NO: 100 - DNA, 4232 bp, Eucalyptus sp.
gacacgcccaaaatccactccttctccctcccttcccttcccttccctctcatgcacaagatcagatcacgcaaaccctagatcaccaccgccagatcaccaccgccatcgccccatctgagattcattcttcccattccccgattgatccgattgattttatactgtaccaataaatccgtaatcttgagagcttttgcgctctgtgcaattcccggcgatggcgtgcataaagggggtgggccggtcggcgtcggttgccatggcccccgacggcgggtacttggcgactgggaccatggccgggactgtggatctctccttcagctcctccgccagcctcgagatcttcggcctcgacttccagtccgacgatcgggatctccccctcatcgccgaatcccccagctccgagcgcttcaaccggctctcctggggcaagaacggatccggctccgacgaattctccctgggcctgatcgccggtggcctcgtcgacgggaccattggcctttggaacccgctctccctgatccgttctgaggctggtgataaggcaatcgtaggacacctttctaggcataaaggacctgttcgtggtcttgagtttaacgtcattgcaccaaacttacttgcttctggggctgatgatggtgaaatttgcatttgggatttggctgcaccaagagaaccttctcatttccctcctcttaggggtagtggttctgctgctcaaggtgaaatttcatttttatcttggaatagcaaagttcaacatatattagcctccacttcctataacgggacaacagttgtatgggatctcaagaaacaaaaaccagtcataagtttttcagattcagttagaaggcgttgctcagttttgcaatggaaccctgacctggctactcaacttgttgttgcatcagatgaagatagttctcctactttaaggctttgggatatgagaaacataatgtcacctgttaaagaatttgcggggcatacaagaggtgttattgcaatgtcctggtgtcctaatgatagttcctatttggtcacctgtgctaaagacaatagaaccatatgctgggatacagttactggagagattgtttgtgaattgcctgctggatccaactggaattttgatgtgcattggtaccctaagatacccggagttatatcagcatcttcatttgatggaaagattggcatctacaatgttgagggttgtagccgctatggtgtcagggaaaatgaattcggggctgcaactctgagagctccaaaatggtttaaacgacctgttggcgcatcctttggttttggaggcaaggtggtttcatttcatactcggtcaacaggaggtccttcagtcaattcctcagaggtttttgtacacgatatcattacagaacaaactttggtgagccgctcgtctgaatttgaagctgcaatccaaagtggggatagaccttcattgagagcattatgtgaaaagaagtctcaacattgcgaatctacagatgaccaagaaacatggggattcttgaaagttttgttagaagatgatggaaccgcaaggtcaaagctacttgctcaccttggtttcgatattcctacggagacaaatgatggttcacaagaggatctctcccagcaagttaatgctcttgggctcgaggatgtgactgcagataaagtagtgcaggaggacaacaacgaaagcatggtgtttcctactgataatggcgaagatttttttaacaatcttcctagtcccagggccgatacaccagtatcaacttctgctgatggctttcctactgtgaatgctgccgtggaaccatcgcaagacgaagtagatggacttgaggagagctctgacccatcgtttgatgatagtgttcaacgtgctttggttgttggagactacaaggctgctgttgcattgtgcatgtctgctaataaattggctgatgctttggttattgcacatgttggaggtgcctccctatgggagagtactcgtgataagtacctcaaaatgagccgcttaccttacttgaaggttgtttttgcaatggtgaataatgatctccagagccttgtggataccaggcccctcaaattctggaaagagacgctcgctattctatgtagttttgcacagggggaggagtgggcgatgctctgcaactctctagcctcaaaacttatggcagctggtaacatgttggcagcgacactctgtttcatttgtgctgggaatattgataaaacagtggaaatttggtcgagaagcctggcaactgaacatgatgggatgtcctacatggaccttcttcaggatttgatggaaaagactattgttcttgcattggctagcggccaaaaacaattcagcgcttcagtgtgcaagcttgtggaaaaatatgcagagattttggctagtcaagggcttttgacaacagcgatggactatttgaagctgttggggacagatgatttgtcacctgaactcgcggtcttgagagatcgtatcgccttctctgtagaagctgaaaaaggagccaacatctctgcttttaatggctctcaagatccaagaggtgcagtatatggtgtcgatcaatccaattatggcatggttgatacttctcagcactattatccggaagctgcacaaccacaggtgccgcatactgttcctggtagtccttatggtgaaaactatcagcagccttttggctcttcatttgggaaaggatacaatactcccatgcaatatcaggctccttcacaggcgtctatgtttgttccatccgagccacctcagaatgcccagccaagttttgttccaactcctgtcaccagtcagcccacgacgagatctcaatttataccagcgcctcctcttgccctgaggaacccagagcagtatcagcagccaacattgggttctcatttgtatccgggaagtgttaatcctacttttcaacctttgcctcatgcacctggtccggttgcccctgtgccaccacaagtgagctctgttcctggccagaatatgccacaagctgtggctcctactcaaatgcgggggtttatgccagttactaatccgggggttgttcaaaatcccgggccaatttccatgcagccggctactcccattgaatcagcagctgcacaaccagttgtctcacctgctgcacccccacctactgtgcagactgcagatacttcaaacgttcctgccccccagaaacctgtcatcgcaacattgacgagactctacaatgagacatcagaagcattgggaggctcacgtgcaaatcctgccaagaagcgtgagatagaagataattcaaggaaaataggtgccttgtttgcaaagctcaacagtggagacatatctaaaaacgcagctgataagcttgtccagctatgtcaggctttagacaacggtgattatagcactgctctgcaaatacaggtacttctcacgactagcgagtgggatgagtgcaatttctggttggcaacgttgaagcggatgatcaagacaaggcagaatgtgagactaagttgagaagaggccaattcttctcaacgcatctcctttgttcttttttctctccttagccttgtgtggtggattctgtaggggaattgatcatttctttggaaagcatggctctcttagattgctactggagtaatttttggtcttttgttatagaatgtcttttttcattgatgctgacttctgaaagccgttaggatagtctttaaaggagttggtgattattgatttccacccaatatatgtagcgtcaaggaattagagagctttttactagccctggtggatgtttttgacactatttttcactataagttactctcccaggctggtctcttctgagatgcccgacgtctgttcatgacttagtgttatagtgatcatttatgaatttttggtatgcttttggtgagtgatagcttgtcaaagagagagagagaggcttgtcacaagaaaacaatcaattatcttgttggtgtggggctgaagattcttcgttttgtttgtattttctttttccattatctggataaggaagacagcagcaaatgttgtcgctgaaaaataaccttgcttttgacactgttgagagaagactcggtaggatgtattattggatgctgttattccaaaaaaaaaa

SEQ ID NO: 101 - DNA, 1751 bp, Eucalyptus sp.
ggaaacgccgagagagggaaaggaaggaaggaaggagaaggagatgaaggagagagggaagggggcggggagatcggtggacgagaggtacacccagtggaagtcgctcgtccccgtcctctacgactggctcgccaaccacaacctcgtctggccctccctctcctgcagatggggtccacagctcgagcaagctacttacaaaaatcgacagcgtctttacctatctgaacagacagatggcagtgttccaaatacacttgttattgcaaatgtcgaggttgtcaaaccaagagttgcagctgcagagcatatctctcagtttaatgaagaagcgcgctctccctttgtcaagaagttcaaaactattatacatcctggggaggtaaacaggatcagggagctgccccaaaacagtaagatagtagcaactcacaccgatagccctgatgtcctcatctgggatgttgagacccagcctaatcgccatgctgttttaggtgcttcaacttcacgtccagatctgatactcaccgggcataaagataatgctgagtttgctcttgcaatgtccccaaccgaacctttcgttctttctggaggtaaagacagatatgtagttttatggagcattcaagatcatatctcaactttggctgcagatcctgggtctgcaaaatctccagggtctgctggaaccaacaataagcagtcttctaaggctgctggtggcaatgataagactggggacagcccttcaattgaacctcgtggagtctacctggggcatggcgacactgttgaggatgtgactttctgcccgtcgagtgcacaggagttctgtagtgtgggggatgattcttgtctcatcctatgggatgcaagaactggctcttctccagctatcaaggttgagaaagctcatcatgctgatctccattgtgttgattggaatcctcatgatgtaaacctgattctaaccgggtcagctgataatacagttcgcatgtttgaccgccgaaacctcacttcggggggagttggatcacctgtccatacttttgagggtcacaatgctgctgtgctctgcgtacagtggtctccagacaagtcatctgtctttggaagttctgctgaggatggcattttaaatatctgggatcatgaaaagattggtagaaagatagagaccgtgggttcaaaagtacccaattctcctccagggttattcttccgtcatgctgggcacagggacaaggttgttgacttccattggaattcatccgatccctggacaattgttagtgtttctgatgatggtgaaagtactggtggaggtggtacactgcagatatggcggatgatcgatttgatttacagacctgaggaagaagttctggctgagctggacaaattcaagtctcacattctctcttgcacctcttgaacttctcataataagaagaaagatcagcaaggttgatgactaacttgaagtgggaagcaagttaaccgtgttcgattgttttgtgtaaaaaggagctcatcatcctcgagtttcatccttttttatgatgctagggattatttagtgcgtctgcttgaggtttagttttgtctcggtgtggacatggagtctgacaaatgtgttctccagcattccttaaggccatggctgagaggctcgttttggttgcttcattggattatgaagagattgcttaatacttaaaaaaaaaaaaaaaaaaaaa

SEQ ID NO: 102 - DNA, 1651 bp, Eucalyptus sp.
ctaatttcaaggttctctttcctttcttgcagacaacactcgcccctcgcttctggtcttttccaaagcaataaaattccctcgttcgccgttcggcgtcttcaccggcggcgcgcgccgcactgcgtacccaccggctgtcgcgttctcgcggatcgaactcgaggaaaaggcatcggcggcggatcggggcaaatggcgaagatcgcgcccgggtgcgaaccggtggcggggacgctgaccccgtcgaagaagagggagtacagggtcaccaacaggctccaggaggggaagcgtcccctctacgccgtcgtcttcaacttcatcgactcccgctacttcaacgtcttcgccaccgtcggcggcaaccgggttactgtttatcagtgtctcgaaggtggagtaatagctgtgttgcagtcatacattgatgaagataaggacgagtcgttttacacggtcagctgggcgtgcaatatcgatagaaccccgtttgtggtggcgggaggaatcaatggtatcatccgtgtaattgatgctggcaatgagaagatacacaggagttttgtaggccatggggattcaataaatgaaatcaggactcaaccattgaacccatccctcatcgtgtctgctagcaaagatgaatccgttaggctctggaacgttcatacgggaatttgtatcctgatatttgctggagctgggggtcatcgcaatgaagttttgagtgtggacttccatccttccgacaagtaccgtattgcaagttgtggtatggacaatacggttaaaatctggtcaatgaaagagttctggacatacgtggagaagtcatttacatggacagatcttccatcgaagtttcccaccaaatacgtgcagtttccagttttcatagctccagttcattcaaactatgttgactgcaacaggtggcttggtgattttgttctgtcaaagagtgttgacaacgagattgtgctttgggaacccaaaatgaaggaacaatctccgggagaggggtcggtggatatccttcagaaatatccagttccagagtgtgacatttggttcatcaaattttcctgtgactttcattatcactcaattgctataggaaatagggaagggaagatctacgtatgggagctgcagagtagccctcctgttctaattgcaaagttgtctcatccccaatcaaaatccccaatcagacagactgccatgtcatttgatgggagcacaatcctgagctgctgtgaggatggtactatatggcgctgggatgcaattacggcatcaacatcctaagccttccatggcagatggactggagaactccgttagtaattatgaatccctcttgtgtgggcatgttccccaccatgtatcagctgaatgggagctgcttcaacctcttatctcgatggagactcgaatagcatcaccgcacagatgcaagcggacaactgctttttcgtaacgaagaaagcaagtggatgatttggttgtgcatcagtctgaacgatttatgaagttactttttggtgtcaaatgtactctccgtgaatcatttcacttcgcaaactgggatttgtaccctagaaacatccagtttaatctaccttaacttcccagaaaaaaaaaa

SEQ ID NO: 103 - DNA, 1887 bp, Eucalyptus sp.
atttcgggaggagtaaaaaaggaaaatgaaaagagagggagagacagagaggtcgggcattatccattcagcataggaggcgggggagaaggagacaaagcccatgagatcatcaggattggtggtgggattactgtttaactgcgacatggatcgagcaatgtcgctgttcactctgttgccactagcggtatgaatacggcaatgcattttggtgctggttggcgatcgattgctgagatggggtatacgatgagcagactagagattgagcctgagtcgtgtgaggacgagaagagcttggatggggttggtaacagccagggaccgaatgagttgccgagatgcttggatcatgagttggcgcatttgacgaatctgaagtcgaggccccatgaacatttgatccgagatttccctgggaggcgggctctgcctgtttccaccgttaagatgctggcgggtcgagagtgtaattattcacgaagagggaggttctcctccgctgattgctgtcacatgctgagcagatatgtgcctgttaatggtccttcgcccctggatcagatgaatagtcgagcttatgtttcgcaattttcagctgatggttctctatttgttgctggctttcagggtagccacattagaatttataatgttgataaaggatggaaatgtcagaagaacattcttaccaagagtttacggtggacgatcactgatacatctctttctcctgaccaacgttaccttgtgtatgccagtatgtcacccatcgtccatattgttgacatcggctccgctgctatggattctcttgcaaacatcacggagatccatgagggtttggatttttccgctgacagtggaccatattcttttggaatcttctctgttaaattttctaccgatggacgagaagtcgtcgctggaagcagcgacgattctatatatgtctatgatcttgtggcaaataagctttccctcagaattccagcacatgagtctgatgtgaacacagtatgctttgctgatgaaagtggtcatataatttattctgggagtgatgatacatactgcaaggtgtgggatagacgttgcctgagtgccagaaataaacctgcaggagttctaatgggacaccttgaaggcattacgttcattgatagccgtggtgatggtcgttatttcatatcaaatggcaaagatcagacgatcaaactttgggatatccggaaaatgggctctgatatctgtcgtcgaggctttaggaatttcgaatgggattacagatggatggactacccaccccgggctagggattcgaaacacccttttgatctgtcagtggcaacatataaaggccattcggtgttgcgtactcttattcggtgctacttctccccagtacatagcactggtcaaaagtatatctacactggatcccatgattcctgtgtttatatctatgatgtggtgactggagctcaagttgcggccctcaagcaccataaatcgccggtcagagactgcagttggcacccggagtacccgatgattgtgagctcttcttgggatggggatattgtgaaatgggaattctttgggaacggagaaactgagatcccggcgatgaagaagaggatccggaggcggcatttgtattaaaagatgcttactatttttcactcgatgacggttggccggataaataatcgcttatatagtcctaataagttccatctcatgtacagataaggtgtatcattcaagctatagtcccaaacgacacgcgattcgtgtgaatttcgttgtacataatcgacctttcgaatgtaattgtgactgtgagccattgttgcttgttacaagcttccaaaaaaaaaa

SEQ ID NO: 104 - DNA, 1917 bp, Eucalyptus sp.
attcactggcctaactactacccgaccgggagcaaccgaagcgcacggtgcccgtcgagcgcgctctctctccggcgatggagccgcagccgcaggccccgaagaagcgcggccggaagccgaagccgaaggaggacaagaaggaggagcagctccaccagccgccgccgccgccgccgccgcagcagcaggcggctccggcgccggcaccggcggccaccaggtcgtcgacgtcggggtcggcggggggccgggaccggaggccgcagcagcagcacgcggtcgacgagaagtacgcgcggtggaagtccctcgtcccagtcctctacgactggctcgccaaccacaacctcctctggccttctctctcttgccggtggggcccgcaactcgagcaagcgacttataagaatcggcagcggctctacatttctgagcagactgatggcagtgttccaaatactttggtgatagcaaactgtgaagttgtgaaacctagagttgcggctgcagagcacgtgtcccagtttaatgaggaagctcgctctcccttcataaggaagtacaagacaattatacatcctggagaggttaacagagtcagggaacttcctcagaatcccaatattgtggcaactcacactgacagcccagatgttctcatttgggatgtggaatctcagcctaaccggcatgctgtctatggagctacagcttctcgtccaaatctgattttaactggacatcaagagaatgctgaatttgcccttgcaatgtgtccagctgaaccctttgttctctctggagggaaggataagacggtggttttgtggagtatccaagaccatataacagcatctgcaacagatcaaacaactaataaatctccaggatctggaggatccatcattaagaagactggggaaggtaacgaggaaactggaaatggcccttctgttggaccacgaggaatctactgtggacatgaggatactgttgaagatgtggctttttgtccatccactgcacaggaattttgtagcgttggtgatgattcatgccttatattgtgggatgcacgagttgggactaatcccgttgctaaggtcgagaaggcacataatggtgacctccattgtgtggattggaatccccatgacaacaacctaatcttaactgggtcggcagataactctgttaacatgtttgatcggcgaaatctcacttctaatggagttggttcaccagtctacaagtttgaggggcataaggcagctgttctttgtgtgcagtggtctccagacaagccttccgtctttgggagttctgctgaagacggtctcttgaacatttgggattatgagagggttgataaaaaggttgacagggctccaaatgctcctgcgggattgtttttccagcatgctggtcacagggacaaaattgtcgacttccactggaacgcagctgatccatggactatggttagcgtatctgatgactgtgatactgctggaggaggtggtacattgcagatatggcgaatgagcgatctgatctacaggccggaagaagaggttttggctgagctggagaatttcaaggcgcatgtactggaatgctcgaaggcatgagagtgcctcgagaacaggccctccgggtctcaaaacactaactagacaaagcgggtttttgctggctgttactgctgtaaaatctgtaggtacttagccatggtttagactcatctgtgagcgccaggactcccctctttacgcagatggtgactgaagctggttccgagatcggcatatgtagctggtagaggtgtggatattgcatagaccgaacctccgcaggtccgcattctcgagtgagaaacagagataaattttaagggggttcccaaaaaaaaaa

SEQ ID NO: 105 - DNA, 2999 bp, Eucalyptus sp.
tccttacccgcccccgaactcgcgaagttcccaacttcaaatccttcggtcaccaccaccgccacctcctccgtcgcgggaacgatggggatattcgagccgtacagagcggtcggatacatcaccaccggcgtccccttctccgtccagcgcctcggcaccgagaccttcgtcaccgtcagcgtcggcaaggctttccaagtgtacaactgcgcgaagctgagcttggtgcttgttggtccccaattgccaaagaaaatacgggccctcgcatcgtaccgtgaatacacttttgctgcttatggaagtgacattggcatattcaagcgtgctcaccagttagcaacttggagcgggcatactgctaaggtttgtttgctgctgctgtttggagagcacatattgagtgtagatgttgatggcaatgcatacatatgggcgttcaaaggaatgaattacaacctttccccagtgggacacatcttgttggatagcaattttactcctagctgtataatgcatccagacacttacttaaataaggttattctgggaagccaggaagggccactgcagctttggaacataagcactaagacaaagctctatgagttcaagggatggaattcctctgttagcagttgtgtttcatcacctgctttagatgttgttgcggttggctgtgctgatggcaagattcacgttcacaatattcgctatgatgaagaattggttacattttctcattcgatgagaggttctgtgaccgccttatctttcagcacagatgggcagcctcttctagcttctggtagttcatctggtgttgtcagcatatggaatctcgataaaagaaggctccagtcagtcataagagatgctcatgacggttctataatttctctccacttctttgctaatgagcctgtgctaatgagttcatctgcagataactcaattaagatgtggattttcgacacaagtgatggagatcctcgtctattacgctttcgaagtggtcatagtgctcctccactctgcataaggttctatgctaatggtaggcatatactatcagctggtcaggatcgtgccttccggcttttctcggttgtccaggatcagcaaagtcgagagctatctcaacgtcatgtgtccaagcgagcaaaaaaattgaagttaaaggaagaagagataaagctgaagcctgttatagcatttgatgttgctgaaattagggagcgggactggtgcaacgtagtgacaagtcatatggataccccgcaggcatacgtgtggagacttcaaaattttgtcataggggagcatattctgagaccatgccccaacaagcccacacctgttaaggcttgcatgattagtgcatgtggaaattttgccattttgggaacagcaggtggttggattgagcgattcaaccttcaatcaggaattagtcgaggaagttacatagaccagttagaaggaacaaacagtgctcatgatggtgaagtggttggagtggcttgtgatgccacaaatactctcatgataagtgccggttatgctggggacatcaaggtctgggatttcaagggacgtgaattgaaatctagatgggaaattggttcttctttggtaaaaatatcttaccatcgtctgaatggtcttttggctacggttgcagatgattttatcattcgcctttttgatgctgtcgccctaagaatggtccgaaagtttgaaggtcatactgatcgaattacagatttgtgctttagtgaggatgggaaatggctcttgtcttccagtatggatggcagtctaaggatttgggatattattttggccagacaagtagatgctgtatttgttgacgtttccatcacagctttatctctgtcaccaaatatggatattttagccacgacacatgttgatcaaaatggggtctttctctgggttaaccaatcaatgttttctggagattctgacatcaatttgtatgcaagtgggaaagaagttgtgaccgtcaagttgccatcagtatcatcagtggaaggttctcaagttgaagaatctaatgagcctactattagacattcagagtctaaagatgtcccttccttccggccttcgcttgagcaaattccagatctagttaccctctcacttttgccaaagagccagtggcagagcttgattaatctagacattataaaggttcgcaataagccagttgagccccccaagaaacctgagaaagctcctttctttttgccttctattccatctctttctggagaaatactatttaagccaagtgagatgtctgataagggagacatgaaagctgatgaagacaaatctaagataacacctgaagtgccatcatcacggtttctgcaactgcttcattcatgttcagaggcgaaaaacttttcaccctttaccacctacatcaaagggttatctccctcaactttggatttggaacttcggatgcttcagataatagatgatgatgctgttgacgctgatgctgatgatccacaagatgttgacaagagacaagagttgctttccattgaactacttatggattactttatacatgaaatatcatgccggagtaattttgagtttgtacaagctctagtcaggttgtttttgaagatacatggggagacaattagacgccagtcagtgttgcagaataaagcaaaggtccttttggagactcagtgctctgtatggcagagagtggataagttatttcaaggtgctagatgcatggttgcctttcttagcaactcacagttttagcaaaaggaagatgttatagacggaaaaagtagctggatcaacactgaggcatgagtttaaatgttggatgggttcctcttagagctataaattcgctcattttgtaactgagcaatcatcctgtatcacttctttcagaaattttcaatggaagcctttttttaaaaaaaaaa

SEQ ID NO: 106 - DNA, 1476 bp, Eucalyptus sp.
ccgtttgcgcgtgctttctctctctctctctctctctcctctgctcacttcttcgggaacttcgattccggccatggaggagacgaaggtgacgtgcgggtcgtggatccgccgcccggagaacgttaacctcgccgtgctggggaggtcgccgcggcgccgcggctccgccgcgctcgagatcttcgccttcgatcccaagtccacttccctctcctcatccccgctggttgctcatgtgatcgaggaaattgaaggcgatccgttggcgatcgcggttcaccccaacggagaggatatcgtgtgcttcgcgagctccggtagttgcttatcatttgaattatctggtcaagaatcaaatttgaagctgttgaccaaggagcttcctcctcttagagggattggtcctcaaaaatgcatggcctttagtgttgatggatctagatttgccactggtggagtggatggtcgtctaagaatcctggaatggcctagtctgcgcatcattctagatgaaccaaaagcacacaaaagcattagagacctggattttagtctagattcagagtttttggctacgacatctactgatggatcggctagaatatggaaggccgaagatggtttgccttgcactactttgactcgcagatctgacgagaagattgaattgtgtcggttctctaaggatggaactaaaccctttctattctgtactgttcaaagaggtgataaagctgttactggtgtttgggacataagtacatggaacaagattgggcacaaacgactcctcagaaagcctgctgttgtaatgtccatcagtttggatggaaaatatcttgctcagggaagcaaagatggtgatatgtgcgttgttgaagtgaagaaaatggaggttagccattggagcaagaggctacacctgggaacctcccttacatcactagaattctgtcccattgaaagggttgtgattactacttctgatgagtggggtgtgttagtgaccaagttaaatgttcctgccgattggaaagcatggcaagtgtatctactacttttgggtttgtttttggcgtctcttgttgcgttctacatcttctatgaaaactccgactcattctggggcttccctcttggaaaggatcaacctgcaagacctaagatcggcagtgttctgggggatcccaagtctgctgatgatcaaaatatgtggggtgaatttgggccattggatatgtgagcaaaccgccggttgtgtcgtgctgcaagtctccagaaggagctgcagcagccagtggtctgaagaactccatttgattattgttacacaaaggcaatttgtttataggtctttttggaacaaaatgtccgcctgggcgtgaacaagcggcatgggactgacaccgtcgctttcattaaagaagtctcatcaaagtcgaactaatacgaattttgattttaaaaaaaaaa

SEQ ID NO: 107 - DNA, 4551 bp, Eucalyptus sp.
ctctcatgaacctcacgaagcgcgcgcacaccagcagctccgcgagcacgagcggcgagcaccacggcaagagccagagctccgcatttcgcagcgcaaatggcggaccccgtagagcaccagcaccagcagcaccagcagcaccagcttcagcagcagcggcggcgcggatggcggattcagggcgggcagtacctcggggaaatctccgctctctgcttcctccacctccctcctcctcccctctccctctcctcctcgccggtactctctctctcttctggactcgactcggaatcgcgagaccgaccggcgtgctccttccgtttcccgtctgcaggttccggctcgcaggtgtcgctgttcgacctggcgtccggggccatggtgcggacgttctacgtcttccgggggatccgcgtgcacgggatcgtcctcggctgcgccgatttccccggcggatcgtcctcgtcttcttcgacgctcgattacgtcatcgccgtgtacggtgagaggagagtgaagctgttccgcctgtccgtgcggctcggaaggggagctggcgaggggagcggaactgtgctgtccgcggatttggagctggtttccgcggcgccgaggttgagccactgggttatggatgttcgcttcttgaaggagaatggaacttctgaggatgagctgcagaggtgtcttaccgttgctataggatgcagtgacaactccatacgcctttgggacgtcgataaatgtagcttcgttcttgcagtttcttcccctgagagatgccttctgtactccatgcggttgtggggtgacaatcttgaagatctccaagttgcatctggaacaatttacaatgagattttgatctggaaagtggttcccaatcatgatgctccatcttcaaatgagctcacagaagaaggcctgacaaactcttgtgctggcaacagcgtccacgaatgtcttcgctatgaagcctatcacatctgtagacttgttggtcatgaaggttcaatatttagaatcgcatggtcctctgatggctccaaactcgtctctgtatctgatgatcgtagtgcacgtatttgggaagttcattgcaaggtgcaatattctgaagatgcgggggaggttggattgctttttggacacagtgctcgagtttgggattgctatatatctgataatttgattgttactgctggcgaggattgctcatgtcgtgtgtggggactggatggacaacagcatgatgtcatcaaagagcatattggaaggggtatatggcggtgtctctatgatccatggtcttcactccttgtcactggtggttttgactctgcaattaaagtgcataaactggatgcttctttagctgaggcttccgcaaaacagtccaacataaaagacttgagtgacggaactgagctatttactacacatcttccgaattcatcaggtcatagcggacacatggacagcaaaagtgagtatgtccgatgcttgagcttctcatgtgaagatgtgatgtatattgccactaatcacggttatctctatcatgctaaattatgcaatgatggcgatctaaggtggactgaacttgctcaagtaagtaatgaggtgcaaattatttgtatggaactgttgccctcaaatccatatgatcctcggattgatgctgatgattgggttgctgttggagacggtaaaggatggacaacagttgtcagagttgtgaagaattctgattctcctaaagtgagcaccagcttctcttgggcagctgaaatggatcgacagctcttgggaatccattggtgcaaatcactaggacataggttcattttcactgctgaccctagaggagccttgaaactttggagattcttcgaggtttcacaatctagttctctttatccagaaaacagtccacggatttccttgattgcagagttcaaatcagatttgggtgctcgaattatgtgcttggatgtggcatttgagagcgagctgctgatctgtggggatctacggggtaatctggttctgttccctttattgaaggacctgttgctggatacctttgtcgtgtcagcagctaaaatctctccagtaaaccattttaaaggagcccatggcatctcagcagtttccagcatttcagtggctcacatgagtttcaatcacattgaattacgttctactggagctgatggatgcatatgctacatggaatatgacaaaggtctgcaatctttaaattttgtagggatgaagcaggtgaaagaattaagcatgattgaatctgtttccactgaaaatgaatctaccggttacagaacaagtggcagttatgcatctggttttgcatccacagattttataatatggaacctagtaactgaggctaaggtcctgcaagtttcatgtggtggttggcggcgtccacattcttattatctgggtgatgtaccagagatgaagaactgctttgcttatgtcaaggatgatattatttacatccgtagacactggataaaggactcaaaggacaagatactccctcaaaatctacgtttgcagttccatggaagggaggtgcattctttatgctttgtcactggagatttccagctccgaaaaaataaacaatcaagttggattgtgactggttgtgaggatgggacagtgaggctgactaggtatactcagtgcactgacaattggtcttcatccaaattacttggagagcatgttggtggatcagctgtcagatcaatatgttgcgtttcaaatatccatacaacctcatcaggtactagcgtgtctgatgtaaagggtatagagaacctcccaaaggatataaagggaacacttatggaggatgaatgtaatccatcattgcttatttctgttggtgcaaagcgtgttctgacttcttggctgctgagaagaagaaaacaggatgggaaagaagatgacgttactgatttacaagaagccgaaaatagttcattgccttcatcagctggatcctctacattttcattccaatggctttccacggacatgccagttaagtactcagtgccttccaaaaaatcaggaagcattaaaaagctaatcggtgtctctgacaccaatgtaagatgtaaatcacttctgcctgatagtgaggctctgcagtcaaaagtatctgcagttgataagaatgaagatgactggagatacctagctgtcactgcttttctcgttagacattctggttctaggttaattgtctgttttattatcgttgcttgttcagatgctacacttgcaatacgagctcttgtcttaccctatcgtctatggtttgatgttgctctgatggttcctctatcatcaccagttctgtcattgcagcatgtcatcattggaagatgtcaattaccagatgaaaatgtgcagattgggaatgtatatgtcgtgattagcggagccactgatgggagcattgctttctgggatctgactgaaagtgttgaagcctttatgaggcggttgtcaaatatccatctagaaaagttcatggattgtcagaaacggccacggactgggagaggaagccagggtggaagatggtggagatccctgagcaaaattgcttgtaaggaacaaccaatcaatgatcctgttactgcgaaagctataaaggaactaaacaggaaattgactggcggtgttgcctgcgggtcttcatcttctatgctagatgcctcccctgagttagatagcaatgcagctaattcctcatttgaaattattgaagtaaatcctttccatgttcttaatggtgttcaccaatctggcgtgaattgccttcatgtttgcgaaacaaaacatggccaaagttccgatggtcgttttctgtaccagttagtcagtggtggtgatgatcaagcacttcatcttcttaaatttgaggtgttggtgcagcccccagtccaagttccagatgttccaaattcagacatcagaaattctatactcgttgaggaatttcttcttgatgagcagaaccagaaaaccaagtgtacaattgaattcatttctcaggaaaaaattgcttctgctcacaactctgctgtaaaaggcgtttggacagacggcacttgggttttctcgactggtcttgatcagcgtgtcaggtgctggattagcaaggatcgtggtacaccaacggagcttgctcattttatcattagtgtgccagagccagaagcattggatgcaagatccatttgctgggaccagtaccaaatagcagtagctggaagagggatgcagatgatcgaatttcatgtgccttcttctgagattcggtaacgacaatcaaaggttttccctttttttctttctttgcccactaaaagttcttcagggcaaagccaaaggtttatccctcattggatttgatatataaactgagagtgtcttgcacaccattaaaatggcccatcaacagtgagttgcatctaaaaaaaaaaaaaaaaaaaaaaa

SEQ ID NO: 108 - DNA, 2577 bp, Eucalyptus sp.
ctgatttgtccaatttgaacatcacatctttgtattcgtacttgacactccttcgacatgccatataaactttcagcaacgctatcgaaccactcatctgatgttcgtgctgtcgcgtcgccttcagatgatttgatcctttctgcgtcgcgtgattctactgcgatttcatggttcagacaatcgccatcttccttcacccccgcctccgtcatacgagcaggctccaggttcgtcaatgcgatagcctacctgccaccgacaccgagagcccctcaagggtatgcggtagtgggcggtcaagacaccgtcgttaacgtcttcgctctgggtcccggcgacaaggaagagcccgaatacacactcgtcggccataccgacaacgtctgtgccctcagcgtgaactcggacgataccatcatttctggatcatgggacaagacagccaaagtttggaaggatttcgctttggtttatgacttgaaaggtcaccaacagtctgtctgggctgtgctggctatgaacgaaaaagagtttctgaccgcttctgcggatagaaccatcaagtactgggtccagcacaaaacaatgcagacatatgaagggcaccgagacgctgtgcgggggttggcgctaattcctgacatcggtttcgcttcgtgttccaatgacagcgaaattcgggtgtggacaatgggaggggacgtggtgtatacgttatcgggacacacgtcttttgtatacagtctgtctgttctgccgaacggcgatttggtctctgcaggagaagatcgctctgtacgggtgtggcgtgacggagagtgctctcaggttatcgttcatccagccatttcggtgtgggcggtatctacgatgccgaacggtgacatcatcagtggatctagtgatggagtagttcgggtcttcagtgaatctgagaagcgttgggctaccgccagtgaactcaaggcacttgaagaccaaattgcaagccaatcccttccgtcacagcaagttggtgacgtcaaaaagaccgatttgccagggcctgaagccctttccgttccagggaaaaaggctggggaagtgaagatgattcggagtggagacgtcgtcgaagcacatcagtgggatagcttggcctctagctggcagaaaataggcgaggttgtggatgcaattggctcaggacgtaaacaactgcacgacggcaaggagtatgactatgtgtttgatgttgatatccaagaaggtgctcctccattgaaactaccttataatgtttccgaaaatccctataccgctgctcagcgtttcctcgaacagaacgacttgcctacgggctatctcgatcaagtggtgaagtttatagaacaaaacactgcaggagtcaagcttggcaatgatggttatgttgacccatttacaggggcatctcgataccagccagcgacacagtccacttcgaatacggcgtcgtcgtcttacatggatccttttacgggtggatcccgccacattgcagagtcagctccttccaatgtaccacagggctctcatgcaactgggatcattccgttttctaagcctatattcttcaaactggccaatgtatctgcaatgcaagccaagatgttccaatttgacgaagttcttcgcaatgaaatatccacagcgactctcgcgatgcgtcctgatgaagtgatcatggtcaacgagacatttacatatctttctaaagtggttacttccacatcctcggcacggacttctctcggatggatccatattgaaacaatcatgcaaatactggacaggtggcctgttcctcaaagatttccggtcatagaccttggtcgtctggtaacggcatactgtatgaatgctttttctggtcccggcgacctcgaaaagttcttcagttgcctattcaggacatcggagtggacttccatcacctctggaagcaaggcgctgaccaaggcgcaagaaacaaatgtactacttctattccgcacgattgcgaactcgttagacggtgcacctttaaacgacatggagtggatcaagcagatatttagggaattggcacagacaccgcaattggttctcaacaagtcccatcggttggcactagcctccgttttgttcaacttttcgtgcatcggcctcaaaggccctgtccctgcggacgtgaggacattgcacctgactataattttgcaggtgttgcgatctccaaacgatgaccccgaggttgcttatcggacctgtgttgccctgggaaacatgctctactcagacaaaacgcgaggcacaccgcgagacgcacaatcgccatcaccaactgaactcaagagtgccgttgccgcaatcaaagggggattctcggatccaaggataaacgatgttcatagagaaatcatgtccctcatctgagcgcgttcaacctgttgcaaaggtttgggggctgtacagcgtgtatttcttgttacgatacttgaggggttagaggcacctacgaattaggaatgttggattgtcgctgtcaagcgctcgacagcatcaaaaaaaaaa

SEQ ID NO: 109 - DNA, 1456 bp, Eucalyptus sp.
ttttccaagtcaaaatctctctctctctctctctctctctctgtgcagcaaggcacggcagctctgggggcggacgccggcggagcaaagcggcgaccaggggagcggctgcaagacgacgtccacgatctccatcctctgtaagaattacttgaaagatgcctccacagaagattgaaagtggacacaaggacacggtccatgatctggcgatggactactatggtaagagactggcgacagcgtcgtcggaccacaccattaacgttgttggagtcagcagctcgggatctcagcatcttgccacgctgatcggccatcaaggacccgtttggcagatatcttgggctcatccgaaattcgggtctttgcttgcttcgtgctcgtatgacggacgggttatcatatggagagaaggtaatccaaatgagtggacgcaggcacaagtatttgaagagcacaaatcatcggtcaattccgttgcttgggctcctcatgagctcggcctttgtctggcttgcggttcatccgatgggaatatttcggtgttcactgctagacaggacggcggttgggatacttcaaggatcgatcaggctcatccggtcggggtcacctccgtgtcgtgggccccgtcgactgcccctggtgcacttgttggttctggcatgatggaacctgttcagaagctctgctcaggtggttgtgataacaccgtgaaggtgtggaagctctacaacagggtctggaagttggactgctttccggtgcttcagatgcacactgactgggtgagggacgttgcctgggcacccaacttgggccttccgaaatcgaccatcgcaagcgcatcgcaggacgggagggtcatcatatggaccttggccaaggaaggggatcaatggcaggggaaggttttgtacgattttaggactccggtttggagggtctcgtggtccctgaccggtaacattttggcggtggcagacgggaataacaatgtctccctttggaacgaagccgttgatggtgagtggatccaggtttcaacagtcgagccataggattcagcttgtggttgtcctgtcgaactgcttttagctgcgcaatgtgcatagagaacgatttgccaacatagtagaacccgcgaacatgcttgggtgtacttcatagatgaatttatgtgctttttgggccggtatagatgctttaaattgttcttgctttgcggctagatatccttatgaatgaagtttggatgataagtggcgccagactttctactcacccttttttgtcagccatgttttgagcgatgcggtgaccagtttggcctgaatagttggtcttaatggcttgtggatttgcaccggctgtttaccattgaaacttgtatgacctattgctgatgaacctcttaatctgctcagaagggtgatcgtttagaaaaaaaaaa

SEQ ID NO: 110 - DNA, 1809 bp, Eucalyptus sp.
gcttccatggcgcaccccgaattctactgatcgaattcgccttctcttctcactgcaaaaccctaaaacgcacgccctctccctctccctctccctctccctctcacagctgccaaaatgtctgctcctatgctggaaatcgaggcccgcgacgtggtcaagatcgtgctccagttctgcaaggagaactcgctgcaccagacgttccagaccttgcagagcgagtgccaggtctccctcaacaccgtcgacagcatcgagacgttcgtcgccgacatcaacagcggcaggtgggacgccatactgcctcaggtcgcccagcttaagctccccaggaatacgttggaggatctgtatgagcagattgtattggaaatgattgaacttcgtgagttggatactgctcgtgcaattctaaggcaaactcaggcaatgggtgtcatgaagcaggagcaacctgaaagatacttgcgacttgagcatctccttgttagaacatattttgatcccaatgaggcttaccaagactccacaaaagaaaaacgacgtgcacaaattgcccaagctcttgctgcggaagttactgtagtgccaccttcaagattgatggccctagtggggcaggcgctcaagtggcagcagcaccaaggattactacctccgggaacccaatttgatctatttcgaggaactgctgctatgaagcaagatgtggatgatatgtaccctacaactctttcacacaccattaagtttggaaccaaaagtcatgcagagtgcgctaggttctcgccagatggacagtttcttgtttcttgctctgtcgatggattcattgaggtctgggattacatgagtgggaagctcaaaaaggatcttcagtatcaggctgatgagaccttcatgatgcatgatgatcccgttctttgtgttgattttagtagagactcggagatgcttgcttctgggtcgcaagatggcaagatcaaagtttggcgaataagaacaggtcaatgcttgcgtcgtcttgaacgtgcacattctcagggtgtcacaagtgtcctcttttcccgtgatggcagtcagttactcagtacctcctttgatggctcagccagaatccatggccttaaatctgggaagcagctgaaagagtttcgaggccactcatcttatgtgaatgatgcaatattcagcaatgatggcagtcgtgttattaccgcctcaagtgattgtactgtaaaggtctgggatgttaagacttcagactgtcttcaaacatttaagcctccacctccattgaggggaggtgatgcttctgttaattctgttcatctcttcccaaagaatgctgatcacatcgttgtttgcaataagacgtcatcaatttatatcatgactctacagggacaggtggtgaagagtctttcatctggtaaaagagagggtggagattttgtggcagcctgtgtatcaccaaaaggtgaatggatttactgtgtcggtgaagacaggaatttgtactgtttcagctgccagtctgggaaattagagcatcttatgaaggttcatgaaaaggatgtaatcggcgtaacacaccatccccaccgtaatctcgttgcaacatacagcgaagatagcacgatgaaactatggaagccttgacgtattatttctcatcttgcgactttgcaattgttagactgttgtagatgtaattgtcatttcatttattgaccggtgaaagattccgagtgtattttagggaaagagcagttataatctcctcattggccaccaaaaaaaaaa

SEQ ID NO: 111 - DNA, 1960 bp, Eucalyptus sp.
gaatccccgaaatcgcactggaaaattccactgcgctgcttctccgaatcgcccccatggatctcctgcaatcttacgcggaggataacgacggcgatctcggccgtcactcctcgccggaaccctcgccgccccgcctcctcccctccaaatccgccgccccgaaggttgacgacaccacgctcgccctcaccgtcgcgcagaccaaccaaaccctagcccgccccatcgacccgtcccagcacgccgtcgctttcaaccccacctacgaccagctctgggccccaatctgcggccccgcccacccctacgccaaggacggcatcgcccagggcatgcgcaaccacaagctcggcttcgtcgaggacgccgccatcggctccttcctcttcgacgagcagtacaacacgttccagaggtacgggtacgccgccgacccctgcgcctccacggggaacgagtacgtcggcgacctcgacgcgctcaagcagaacgacggcatctcggtgtacaatatccgccagcaggagcagaagaagtatgctgaagagtacgcgaagaagaagggcgaggagaggggcgagggcggcagggagaaggcggaggtggtttccgataagagcacattccatggtaaagaggagagggattatcagggcaggtcgtggatcgcgccgcccaaggacgccaaggcaacgaatgatcattgttatatacccaagagattggtgcacacctggagtgggcacaccaagggcgtgtctgccattaggttcttccccaagcatggtcacttgatcctctcagctgggatggatactaaggtgaagatctgggacgtgttcaattcgggtaagtgtatgaggacttacatgggtcattcgaaagctgttagggacatatcgttttgtaatgacgggactaagttcttgactgccggttatgataagaacatcaaatattgggatactgaaaccgggaaggttatctctactttttccactgggaaaattccttatgtggttaagttgcatccggacgatgaaaagcagaatattttgttggcgggaatgagcgataaaaagattgttcagtgggatatgaatacggggcagattacacaggaatatgatcagcatttgggtgcggtgaatacgattacctttgttgatgataaccggaggtttgtgacgtcaagcgatgataagtcccttcgtgtttgggaatttgggatccctgtggttattaagtatataagtgagcctcatatgcattctatgccctcgatctcgctgcatccaaatacgaattggcttgcagcacagagtctggacaatcagattcttatttatagcactagggaaagatttcagctcaataagaagaagaggtttgctggccacattgtggctggctacgcctgtcaagttaacttctcaccagatggtcgttttgttatgtctggagatggagagggtagatgctggttctgggactggaagagttgcaaagtcttcagaactctgaaatgtcatgagggggtatgtattgggtgtgagtggcatccactggaacaaagtaaagtagcaacctgtggctgggatggcttaatcaagtattgggactgatcttcttgcacctttcatgcaaaggcgtttgatacttctttgcttctcacattgtggacactgaacagcctgtggaacacaaggcatactttccgaggtcaatcagttggaatctgctcagactagggaatctgcatgacagtggtgtacttacaaactccttttgtaactagatgcaaaatcttcaccagcctgttgtacttcagtttattttgctagcagaacattcaccaccaattttcccagtgtactgcgagagtgatgctacataagtttactcttgtgtctaacttttccaattagatccagattgagttgacataaaaaaaaaa

SEQ ID NO: 112 - DNA, 1752 bp, Eucalyptus sp.
ggggcaaacaccatggaaagattttgaacctgctagaaaatggcggcagtcattccgcaggcaattagggtttcagcatacctccggaaacgtccgcaagaatcaatcatctctccctcgccatgcgaacggagctcgattatagggtgtgatcgtcccaatttcgaaagcaaaagacttgtctttaatcgagaaattggggctttttagctggcgggtggaagttagggttttgattcggtgcagaagatggaaagcaacggcaatttggagcagactttgcaagatgggaggatatacaggcagctcaattcgctcatcgtcgctcatcttcgcgaccacaacttcccgcaggcggcaagtgcggttgctctagcaacaatgacgcccttgaatgttgaagccccaagaaataggcttcttgagctggttgccaagggtcttgcagtggaaaagggtgaactattgagaggtgtttctcatgctgggacaaatgatctgggtggatcaatacctgcttcatatggcttggttccagctccgtggaccgctattgatttcagttctctgcgagacacaaagggcatgtccaagagtttcactaaacatgagaccaggcatctttcagaccacaagaatgttgccagatgtgcaaggtttagcactgatggaaggttttttgcaacaggaagtgcagacacttcaattaagctctttgaggtctcaaaaataaagcaaatgatgctaccagattctacagatggcgctatacgagctgttatacggacattttatgaccatacacatcctgtaaatgacttggattttcatcctcaaaatactgtcctgatatctgcagccaaagaccatacagtaaagttctttgattattcaaaggctacagcaaagagagcattcagagttattcaggatactcacaatgtacgttcagttgctttccatccttctggcgactttcttttggctgggactgatcatccaattccacacttgtatgatgtcaacacattccaatgctatctttctgcaaatgtcccagaatttgcagttaatgcagcgataaaccaggtaagatattcatctagtggcggcatgtatgttacagcatctaaagatggtactatacgattttgggatggggcatcggccaactgcgttcgctccattgctggtgcacatggggcagctgaagtaactagtgccaacttcacgaaggatcagagatatgtactctcttgtgggaaggactctactgtgaaactctgggaagttggcacaggaagattggttaaacaatatcttggagccactcacatgcagttgcgatgccaggctgtcttcaacaatacagaagagtttgttctatccattgatgaaccgagcaatgagatagtggtctgggatgccatgacagcagaaaaagtggcaagatggccatccaaccataatggccctcctcgttggattgagcactcacccacagaagcagcttttgtatcctgcggaactgacagatcgatccgattctggaaggaaactcactagggtgatctatggagatgatcgtgatatttgcagcctcggacatcttagaagtgatcacaatttgattcagaaggatgatggccccatacactgcgccttccacaaattctttccgtctttgtaaggaacttgtgaggtattcgaggggacattgtcaataacttatatcctacctctaatggaatt

SEQ ID NO: 113 - DNA, 1613 bp, Eucalyptus sp.
atttccggtttccagatcgatcgcccagccccgtcgcaccgccccccgccctctctctctctccaatccgcgccgaggtgaatcgcgttcattgttgtgataaagatgtccaatttccaaggggaggatggtgagtatgtagcagatgacttcgaagcagaagatggcgatgaagagctccatggcagagaatcggcagacccagaatctgatgttgatgaaatagacactccaagtaatagatttaccgatactactgctgatcaagcaagaagaggaagagatattcagggaattccttgggaaaggcttagcatcaccagggagaagtaccggcggactaggctagaacaatataagaattatgaaaatgttcctcagtctggagagaaatcggggaaggattgcacagttacagagaaaggtaactcattttatgagtttagacggaactcaagatctgtcaaatctactattcttcatttccagttgaggaatttggtttgggcaacatcaaagcacgatgtttacttgatgtcaaactattctgtcgtccattggtcttcattgacgggcaagaagtctgaagttcttaatcttgcaggacatgtggcaccaaatgagaaacatcctggaagcttgttggaaggatttacgcagactcaagtcagtactctagcagtaaaggatagatttctagttgcaggcgggtttcagggagagctcatatgcaagtttttagatcgacctggaattagcttctgttccaggacaacctatgatgataatgccataacaaatgcggttgagatatacgtcagccccagtggtggaattcactttatagcatcgaacaatgactgtggagtcagagactttgatatggaaaactttgagctgtctaaacattttcgtttcccttggcctgtgaatcatacttctttgagtccagatgggaagcttcttgtcatagttggcgatgatcctgagggtattttggttgatgcaaaaactggaaaaacaatcatgccgttgcgcgggcatttggatttctcctttgcatcggagtggcacccagatggtgtcacttttgctacgggaaaccaggacaaaacttgtaggatttgggacatacgaaacttatctaagtcaatcgctgttttgaaaggcaaccttggagccatacggtctatccgctatacatccgatggccggtatatggcgatagcagaacctgcagattttgtccatgtctacgacacgaaaacggggtacaagaaagagcaggagatagacttcttcggcgagatatccggcatgtcgttcagtcccgacacagaatcgctcttcattggagtgtgggaccgaacatatggtagcctcctcgagtatggccggcgacggaacttctcgtacctcgactgcctcgtctgaatagaatgtgcggtcactgttaataattttctttcgactgtgcagctttttgggtgataaatgtgtgagtacgtggacagagcatggtgcacaggggagttccattttgtgtgggtgaaatgtttgtatatatgggtcgagtagaatcttgatgtcttatatgattttagttggcacag

SEQ ID NO: 114 - DNA, 2264 bp, Eucalyptus sp.
gctactgcactgcgctctcggcgccctccaaacgaccgaggaaagcttcagctgaaaaaagcttcggctacaatcccttcaggttcggcttgatatatatggttttctgctagcgacgcgcgcctggagtgttgattcgagtaggacccgtatcgcgtcgattgcctagcgttccgtcaattcgccgtcatgggtgttgaagaggatctcgaagatttgaatgccctcgcggagtctaccgatgccgccgtcgatggccaggcggctctggcttccgccgtcgatagcgttacccttcagccggccccgccaatacttccccccgtaatccctcctcccgccgtgcctgtggttgctcccgttccgacaattcctccggtccttcgacctctggcgcctctacccatccgccctcccgttttgaggcctcccgcacccaaaagagatgaggctggaagtagcgactcggattcagaccatgatggtaccgctgccgggtcgactgcagagtatgagattacggaagagagtaggctggtgcgggagcggcatgaaaaggcgatgcaggatctgatgatgaagcggcgcggtgctgctctggcggtgcccactaatgataaggctgtgcgtgcccgtcttcgtcggctcggagaacctatgaccctctttggggaaagagagatggagaggcgggaccggctgcggatgcttatggctaaattagatgcggaaggacagctcgagaagctcatgaaagcccacgaggatgaggaggctgctgcttccgctgcaccggaggatgtcgaggaagagatgcttcagtatccattctatactgaaggatcgaaagctcttttcaatgctagaatagatattgcaaaattttcgatcacaagggctgcactccgtcttgaacgtgcaagaaggagaagggatgaccctgatgaggatgtggatgcagagatagattgggcattgaaaaaggcagagagcttgtccttgcattgcagtgagattggcgatgatcgaccactttcaggctgctctttctcccacgatggaaagttgcttgccacatgttccatgagtggagttgctaagttatgggacacatgtcgcatgcctcaagtgaatagagtgttgacattgaagggtcacacagaacgtgctactgatgtggccttttctccggtgcaaaatcatatagcaactgcttctgctgaccggactgcaaagttatggaatactgaaggaactatcttgaagacttttgaggggcatctggatcgccttggtcgtattgcatttcatccatcagggaagtacctgggtacgactagctttgacaagacatggaggttgtgggatatagaaagtggtgaggaactacttcttcaagaaggccatagcagaagtatctatgggatagacttccaccgggatggatccttagtggcatcttgcggactggatgctcttgcacgtgtttgggacctccgcaccggtagaagcatccttgctttggaaggacatgttaagccggttctgggagtcagcttttcacccaatggatatcatttagccaccggtggtgaagataatacctgtcgtatttgggatttaagaaagaaaaagtcattgtatactattccagctcatgcaaatcttatatcagaagtgaaatttgagcctcaagaaggatattttctggtgactgcatcatatgatactacggcaaaggtctggtcggcccgggactttaagccagtgaaaactttgtcagtgcatgaagccaaaataacatcagtggatatcactgcggatgcaagtcatatagttacagtgtcgcatgacagaacaattaagctctggactagtaacgacgacgtgaaggaacaggccatggatgttgactgaattcaatttttgttagcatgtgctgttttagcgggagcacggaagttgatcctgtcaagcgtttgtaaacattttggcagatctttccccgtttaaaagcgtttctagcttgcttgtactatagtttttcaattggctgcccgtaaggtattcaaaagtaccaaaccatcctagcagtagtttttgcccttgacatgttttggcctgtgatccaaggaaagttctgatgtggagtgtcttacgtcttacgaacaaggagaggacactttatgaggtatcgcttcctcatttttcatatctatcgttattgccattagaatcaaagcccatttgcttgaaaaaaaaaa

SEQ ID NO: 115 - DNA, 3153 bp, Eucalyptus sp.
atagtttcaacagcctgcgaagctcttccccccctgaaccagacacagtctctctctctctctctctctcttctctcgcgccacggcagctgccaaatgcgatggtgaaggcttacctgaggtacgaaccggcggcggccttcggggtgatcgcgtcggtggagtccaacatcgcgtacgacgcctccggcaagcacctcctcgccccggcgctcgagaaggtcggcgtctggcacgtgcggcagggcgtctgcaccaaagccctagccccttccgcctcctccgccgccggaccctccctcgccgtcacggccatcgcctcctctccttcgtctctgattgcgagtggatatgctgatggtagcatacggatatgggattttgagaaaggttcttgcgagacgacactgaatggccataaaggggctgtctctgtactcagatatggcaagcttggatctttactcgcatctggaagcaaggacaacgacattatattgtgggatgtagtcggagagactggtctttaccgcttacgagggcatcgcgatcaggttaccgaccttgtctttctagattctgacaagaaactcgttagttcctccaaagacaagtatctcagagtgtgggatcttgaaacacagcactgtatgcagattgttggtggtcatcacagtgaaatctggtccctggacactgatccagaagagagatatctcgtcacagggtctgcagatccagaacttcgattttacactgttaagaatgattcatctgatgaacgatctgaagcagatgcaagtgggggtgtgggcaatggtgacttagcttctcataacaaatgggatgtactaaaacaatttggcgaaattcagcgacaaagcaaggatagagttgcaacagtgagattcaacaagaatgggaatttgctggcttgtcaagcggcaggtaaacttgtagaggtgttccgtgtactagatgaagctgaagcaaagcgtaaagcaaaacgcaggcttcataggaagagggagaagaaaggggcagatgtgaatgaaaatggagattccagtcgtggtattggagaaggacacgacaccatggtgacggttgctgatgtttttaagctcctccagactattcgagctagcaaaaagatttgttctatttctttctgccctgtagctcctaagagttcgttggccacactggcattgtcattaaacaataatcttttggaatttcactctattgaagctgataaaactagtaaaatgctaactattgaactacaaggacaccgctctgatgtcagaagcgtcacccttagttctgataatacccttcttatgtctaccagtcacaactcggtaaagatttggaacccgagtacaggttcctgcttgcgaacaattgactctgggtatgggctttgtggtttaattgttcctcagaataagcacgcacttattggaacaaaagatggagccatagaaatatttgatgttggaagtggcacttgtattgaagtggtagaagctcatggaggctctatccggtcaattgtggctataccaaaccaaaatggttttgtcactggcagtgcagatcacgacattaaattctgggagtatggtatgaagcagaaacctggtgataattccaagcacctaactgtgtcaaatgtcagaaccctgaagatgaatgatgatgttcttgtggttgctgtgagcccagacgctcaaaaaattgctgttgcactattagactgcacagtgaaggttttcttcatggattctctgaagcttatgcattccttatatgggcacaggcttcctgtgctatgcttggatatctcgtcagatggagatctaattgtaactggctctgcagataaaaatctgatgatatggggattggattttggtgaccgccataaatccatttttgcacatggagatagtatcatggcagtgcagtttgtgggcaacacacattatatgtttagtgtaggtaaagatcggcttgtaaaatactgggatgctgacaaattcgagcttcttttgacgcttgagggacatcatgctgatatttggtgccttgcaattagcaaccgtggtgattttttggtcactggatctcatgatcgttcaatacgccgttgggatcgtacggaagaaccattcttcattgaggaagaaaaggagaagaggttggaggagatgtttgagtctgaccttgataatgcatttgggaacaagtatgtacccaaggaagaaattccagaagagggtgctgtggccttagcagggaagaaaactcaagagacactttcagcaactgattcaattattgaggcgttggatatagcagaagtggagttgaaacgaattgccgaacatgaggaggagaaaaacaatggaaagactgcagaattccacccaaattacgtgatgctggggctttctccctctgactttattcttcgtgctctttcgaacgttcaaactaatgaccttgagcagacattactggctttacctttctcagatgctttgaagctcctatcttacctgaaggattggacaacataccctgataaggttgagcttgtttcaaggattgctacagtgcttttacagacacattacaatcaattagtttcaaccccggctgccaggcctttgttgactacactaaaggacattcttcacaagaaagtcaaggaatgtaaggacacgattggatttaatcttgcagcaatggaccatcttaagcaattgatggccttaagatcagatgcactctttcaagatgccaaagtgaagttgctggaaattcgctcacaactttccaaacgactggaagaaaggacggacccgagagaagcaaagcgcaggaagaagaaacagaagaaatccactaacatgcatgcctggccatgaggtcttggtaatgagaattcgctagttgaagaattcgggaattttttgccacatcgtaaccatcatagcacttatcatctaattatggtgaaagggagttatatatatgtcagttttggcggatgttgagtgtataggatgtgaaatagcaaatgataatctctcttctatcttttgggcaattgaacttttcattcccataaaaaaaaaa

SEQ ID NO: 116 - DNA, 1282 bp, Eucalyptus sp.
gcccccggacgtctccagacctctcgctgcgtctgcacagcatctccgtcggaagttcccgtgcgacaatcgacatgggcggcgtgcaagccgagagagaagacaaggacaaggtctctctggagctcaccgaggagatcctccagagcatggaagtcggcatgacgttcagagactatagtggtagaatcagttccatggattttcaccgggcctcgagctatctagtgacagccagcgatgatgagtctattcgcctttatgatgtggcaagcgcaacatgtctgaagacaattaatagcaaaaagtatggggttgatttggtctcattcacttctcatccgatgactgttatatactcctcaaagaatggttgggatgagtcactgaggctgttatccttgcatgacaacaagtacctgcgctactttaaaggtcaccatgacagggttgtctcccttagcttgtgcccacgcaatgaatgctttatctctggttctctggatcgcactgttttactctgggatcaacgagctgagaagtgtcagggtcttttacgtgtacaaggaaggcctgccacagcttatgatgatccgggcctggtgtttgcaattgcttttggaggatgtgttaggatgtttgatgctcgcaaatatgaaaaaggtcctttcgaaatcttttctgttgggggagatgtgtcggatgcaaacgttgtcaagtttagcaatgacggaaggcttatgcttttgactaccacagatgggcatatacatgttctcgactcattccgaggcacactgttatacactttcaatgtcaagccaacatcaagcaagtccaccttggaggcatcttttagccctgaaggaatgtttgtcatttctggttctggagatggcagtgtctatgcgtggagcgtaaggggcgggaaagaggtcgcaagttggttaagtactgacacggagcctcctgtcataaaatgggccccaggaaacctcatgttcgcaacaggatcgtcggaattatcattctggattcctgatctctctaaattgggagcttatgttggaagaaagtagaagggtcgggatagtcattgcttagaggcaacgcagttgcaagtctaccattcccaccaattataatttggaaagagtttaagatgctgacttatccaggaaaaggttgtttatacttataaacaacagagagacaactgtacaggtgttgtaaacactcccagtgtgagggtaattttggaagttgtgccttaaaaaaaaaa

SEQ ID NO: 117 - DNA, 1483 bp, Eucalyptus sp.
acttgaaaaatctctactttttttccctcttctgagagagaagttctccgcctcgaagccgcgacggcgcccgccctcctcctcgctccgccgctgcaatggccgctttcggagcagctcccgccgggaaccataaccctaacaagtcttccgaggtgattcaacctcccagcgattccgtttcgagcctgtgttttagcccgagggccaatcacttagttgctacttcgtgggataatcaggtacggtgctgggaacttacgaagaatggggcttctgtaactagcgtgcccaaggcgtcgatgtcccatgaccaaccggtactttgttcagcttggaaggatgatggaacgactgtcttttctggcggctgtgataaacaagcaaaaatgtggtctttaatgtctggaggtcagccagtgacagttgccatgcatgacgcacccattaaggagattgcttggatcccagagatgaatgtcttagttacaggaagctgggacaagaccctgaagtactgggacacgaggcagtcaaatccagtacatactcaacagctcccagagcgctgctatgcaatgacagtgagatatcccctgatggttgttggcactgcagataggaatcttattgtctttaatctgcagaatcctcaggctgagttcaagagattttcttcacccctaaagtaccagacaagatgtgttgcagctttccctgaccaacaaggtttcctggttggatccatcgaggggagggttggcgttcatcacctggatgattcccagatcagtaaaaacttcacatttaagtgtcatagagataacaacgacatttattctgtcaactccttgaatttccatccagtgcatcatacctttgccactgctggatctgatggtacttttaacttttgggacaaggatagtaagcagagacttaaggcaatgtcaagatgcagccaaccaataccttgtagcaccttcaataatgacggcacaatatatgcatattcggtctgttatgactggagcaagggggcagaaaatcacaatcctgctacagcaaagacctacatcttcttgcacttaccacaggaatcggaggtcaaagcaaagccacgggttggaacaactaacaggaagtgaagttgctgattagtttagaatatgaagttttgaggaaaacagtggcagtgaagaaaatggtgctattcatttgccagaaattgtagaataggaatggtccttccctctcattgtggttttttgagtcatagtaatccattgttgatattttttttttcctttttttgctcattttcatataccagtaacttttgcggtctctgataggccaagttctattaactgtggtagatgggaagagtggcgcttatttcagtactgtttttgtcaagtcatgtctatcacattgatgtttgaagattaaatacattttgtacttttccggaaaaaaaaaa

SEQ ID NO: 118 - DNA, 2096 bp, Eucalyptus sp.
gacacgcgccctctctctctccctctctctccccctccctctctccctccccttgccgctgctctccaaaatcttccaccaaatctcttcttcttcaaagacgcagcagcagcagcagcagcagcagccgccccagcagccctcgctacacgctccctctctcgccctcccccaagccgcgtgcggcggaaaccgaagccctagctctcgctccctctcctctctcgcgaaatgaactgttccatatccggcgaggtgccggaggagcccgtcgtctcgaccaagtccggccacgtcttcgagaggcgcctaatcgagcgatacgtttcggattatggaaagtgcccagtttccggggaaccacttaccatggatgatgtcctccctgtgaaaatgggaaagatagtcaagcccagacctttgcaggctgccagcatacctgggttgctcagcattttccaaaatgaatgggacagcttgatgctttccaactttgcactggaacaacaactgcacacagctaggcaagagctaagtcatgcattgtaccagcatgatgctgcttgccgtgttattgcaagacttaagaaggaaagggatgaagcccgatcattacttgcactggctgaaagacagatacccatgacagcatcttctgatattgcagtgaatgctcctgccatgagcaatgggagaaaagcttctctagatgaagagccaggctatgccgggaagaaaatgcgacctggtatttctgcaagcatcattgctgagataacggattgtaacttagcactttctcaacagcgtaaaaagcgacagattccctctacactggcacctgttgaggatttggagaggtacacccaactttctagttatccactgcacaaaactggcaaaccaggcattacatctcttgatatttgtcattccaaggatatcattgcaactggtgggattgacacatctgctgtactttttgatcgatcatctggacagatcatgtctacactatcagggcactcaaagaaggttactagtgtgaattttgatgcccaaggtgatatggttttaactggttctgcagataagactgtgcggatttggcaaggttctgaagatgggagctataactgtcggcatatattgaaagatcatactgctgaggtgcaagcaatcacagttcatgctacaaataactactttgcaacagcatctctcgataatacatggtgcttttatgagttttcaactggtttatgtcttactcaggttgaaggcgcttcaggatctgagggttatacatctgcagctttccatcccgatggtcttatcctgggtactggcacctcgaatgccgatgttaaaatatgggatgtaaaaacacaggcgaatgttacaacattttctggccataccggggcaattactgccatatctttctctgagaatggatacttccttgcgactgcagctcaggatggggttaagctgtgggatctgcggaagttgaagaactttcgcacgttttcggcatatgacaaagacaccgggacaaattctgttgaatttgatcatagtggatgttatcttggacttgccggctcagatataagagtataccaagttgccagtgtaaaatcagagtggaattgtgtcaagactttccctgatctatctgggacaggtaaagtgacatgcgttaagttcggtccggattcaaaatacattgctgtcggatcgatggatcacaatttgcgaatctttggattgccttcggaggacggtgctatggaatcatgaagtgttgggatcacatctagcaggtaggatcagcttttgtgagagcaaagtagagtttaagtttcgttgtgcttggaccggaaaactcacatgcttagagtttaagctttgtgccagctgaatcagagtatgaaacatcctgtactgctgcagtgaacgattagcggccctttgtctaacatgattacgattctttgtttttcttttcgaattttgccttcttgagcactaagtcgtgtatactattgttgtacaagattttgggactgacccattctctaaaaaaaaaa

SEQ ID NO: 119 - DNA, 1252 bp, Eucalyptus sp.
aaaaattctctcttcagtgtttttctttgtgctccctgcacctttgcacattaacctttgggaaggcaataatggcggcgcctggagtcgagactttgaagaaagagattaaggagcttaaagagaaaatcgcacaacataggctcgacactgatggggagcaaccattgcccgctgctgccaagtctaagtcagtgcctgaagtttctgcagcattgaagcagagacgtattctgaagggtcactttggcaaaatctatgctttgcactggtccgcagactcccgacacctcgttagcgcctcacaggatggcaaactcattatttggaacggcttcacgaccaacaaagtgcacgcgatcccactgcggtcgtcttgggtcatgacctgcgcctattctcccagtggcaacctcgttgcctgtggtggcttggacaacctgtgctcggtgtacaaggttccgcatggaggaaacaaggaatcttcttcggctcagaagacgtatggtgaactcgcacaacatgaaggatacctttcttgctgccgattcatcaaggacaacgagattgtgacgtcctccggcgactctacttgcattttgtgggatgtggaaaccaagacgcccaaggccatcttcaatgatcacacaggagacgtcatgtctctcgctgtttttgacgacaagggcgttttcgtttctggctcttgcgacgctaccgccaagctgtgggatcaccgcgtgcacaagcaatgcgttatgaccttccaaggccatgaatccgacatcaacagtgtgcagttcttcccggacggcgacgctttcggcactggctctgacgactcttcttgccgtctctttgacattcgcgcctaccaacaaattaacaaatattccagtgacaagatcttgtgtggaatcacatccgtcgccttctcgaagactggcaagagcttgtttgctggctatgatgactacaacacttatgtttgggacactctgagtggaaatcaggttgaggttctgaccggacacgagaatcgtgtgagctgcttgggtgtcagcgaagatggcaaagcactagccactggcagctgggatacattgctcaagatttgggcataacttgtatgaactttttctgttgtcgacactgtaattacacgagctccccttcttttgctgtgtatgtcgaggttgtttgttgctatttgatggattgtccgataaagctgacaacacgaaaaaaaaaa

SEQ ID NO: 120 - DNA, 2250 bp, Eucalyptus sp.
aagctgtttcttcttttttcccctcgcctcctgagcacaggaaggatcgtatcttttttcgaccctcttgccgcttccttctcgtgcgcccccaattcgcgttcatctgcggctgtattatcaaatgactctggtggatggtaggtgaagagtttataacccacaaaccctacccgtcctacagcagccaacattctccttactctatctccggagtagtccaaagcaacttgtccattactttggatcataaacttctcctaagatctggccttttacaagctcaataatttatgggctgaggtgcacttttcatgggaggtgttgaggatgagagtgaaccagcctcaaaacgcatgaagttatcatccagagttttgagaggtcttgcaaacggttcatctcgtacagagcctgcagctggctcttcactagatttaatggctcggcccctaccaattgaaggggacgaagaagttattggttcaaagggtgtgatcaaaagagttgaatttgtacgacttatagcgaaggcattatactccctcggttatgaaaaaagtggtgctcgcttggaggaagagtctgggataccgttgcagtcctctgtggtaaatttgttcatgcaacagatatctgatgggctttgggatgaaagcgtggtgacgttgcataaaattggtctctctgatgaaaatttagtaaagtcagcctctttcttgatattggagcagaaattcttagaacttctggatcaggaaaaagctatggatgctctgaagacgttaaggacggagatcacacctctttgcataaaaaatagtagggtacgtgagctctcgtcgtgcatcatctctccatcatcatgtgggcttcttaaccagaataaaagaaatagtacaagagcaaggtcccgttcagagcttctggaggaattgcaaaaattacttcctccagcagttattattccagaaagaaggttggaacatctggtggagcaggcccttgtcctgcaaacagatgcatgtatgcttcataactctatagatatggaaatgtcactgtacactgatcatcaatgtggtaaagaacacatcccctgtcgaactttgcagattttacaatcacataatgatgaagtttggcttgtgcaattttcacataatgggaaatatttagcttctgcatccaatgatcgatcagcaatcatttgggaggttgatgagaatggcagcgtctcattgaagcataaattgactggtcaccagaagccgatttcttctgtctgttggagtccagatgaccgacagcttctcacttgtggggttggggagacagtgaggcgctgggatgtctcttctggtgaatgccttcgtgtttatgagaaagctggccatggcctcatttcatgtgcgtggtttccagatggaaaatggatatgttatggtgttagtgatcggagcatatgcatgtgcgacttggaggggaaagagattgaatgctggaaagggcagagaactcttagtatttctgatttggaaattactagcgatggaaagcagatcataagtatatgtagagaaactgcaatacttttacttgaccgggaagcaaaatatgaaagaatgatagaagaaaatcaaacgataacttctttctcattgtcaaaggataatagatacttgcttgttaatctcttgaatcaagagatccatctttgggatataaaaggggatttcaggctggttgcaaagtacaaaggtcttaagcgcagtcggtttgtaatcaggtcttgtttcggtggactcaaacaggcctttgttgccagtggtagtgaagactcacaggtttacatttggcacaaaggctcaggtgagctgatcgagccattgccaggtcactcaggagctgtgaattgcgtgagctggaacccagcaaaccaccacatgttggcatcggccagtgacgaccgtaccatccggatatggggcttgaatgagctaaacacgaggcacaagggtgcacgccccaatggtgtccactactgtaatggcaatggcaccagctgaagaagaagaagaaagatgcatggctctagctgagagccctgatgctgctttgttagccattgctttggtgtaaatacgtatgttcatctaaaaagcagacacattcatgtcagaccaagcatgtgaatcttcagcaaacttactggtaataaatttttactatttcatcataaaaaaaaaa

SEQ ID NO: 121 - DNA, 2252 bp, Eucalyptus sp.
cctttcaaaattccctctctctttcttttctctctctagccagatctcatctccttcttcccctttcccctttcatctctgcatctgtacatgccctaatttctctctccctctctctctctctcttgtttctctctctagaagatgacgcagctggcggagacctacgcgtgcatgccctcgacggagcgcggccgcgggatcctcatcgccggcaacccgaagcccgggtccaactccgtcctctacaccaacggccgatccgtcgtcatcctcaacctcgacaacccgctcgacatctccgtctacgccgagcatgcctaccccgccaccgtcgcccgcttctcccccaacggcgagtgggtcgcctccgccgactcctccggcgccgtccgcatctggggcgcctacaacgaccacgtcctcaagaaggagttcaaggtcctgtccggccggatcgacgatctccagtggtcccccgacggcctcaggatcgtggcttccggcgatgggaagggcaaatcgctcgtccgcgcgtttatgtgggactcaggcaccaatgtgggagaattcgatggccattcacgtcgagttctgagctgtgcttttaagccaactcggccctttcgcattgtgacttgtggagaggattttttggtgaacttttatgaaggaccgccttttaaattcaagctgtctcgcagggatcattccaactttgtcaactgcttgagattttctccagatggcaacaggttcattagcgtgagctctgataaaaagggaatcatctatgatggtaagactggtgagaagataggagagctgtcatctgatggtggtcacacaggtagcatttatgctgtcagttggagtcctgatagtaagcaggttataactgtgtctgctgacaagtcagcgaagatatgggacatttctgaggatggcagtggtaacctaaggaaaacattgacttcttctggttcaggcggggttgatgatatgttagtcggttgtctttggcaaaacaaccacctagtcactgtctctcttggtggcacaatcagcatatacacagcaggtgatcttgataaagcacctgtctctttttctggacacatgaagaacgtctcttccttatctgtgctcaaaggtgatccaaaagtgatcctctccagcagctatgatggtcttataataaaatggattcaaggaattggatttagtggcagagtacagaggaaagagtctacacaaatcaaatgtttggctgcagtagatgaggagattgtaacctctggatatgataataaggtatgcagagtttctggcagtggagatgcagaattcattgacattggctgtcaacccaaggacttgagtcttgcccttcagtgtcctgaatttgctttggtttcaaccgatactggagttgtcttgctccgcggtgcaaaaattgtgtcaaccatcaatcttgggtttgctgtgacagcatcaactgtcgcaccagatggaactgaagcaattattggtgcacaggacggaaaattgcgcatatattctatttcaggtgatacattaacagaggaagctgttctggagaaacacagaggtgctattagtgtcatacactactcgcctgatttatccatgtttgcttctggggatctgaacagagaggctgttgtttgggatcgtgcctcaagagaggtgaggctgaagaatatcttgtaccacacagcccgcatcaactgtttggcttggtcccctgatagcagcacagtagcaactggatcacttgacacttgtgtcatcatctatgaagttgacaagccagcatctaaccgtctaaccataaaaggagctcacttgggtggggtttatggattagctttcaccgatgacttcagtgtggtcagttctggtgaggatgcgtgcattcgtgtctggaagataaacagacagtgatcttggggagattatgtgaagtttcagaaatcgcatctacttgagggtagatttgctgtaagaagtgggaggctttttttcggctgcgtcaaccattagagtccgagctgcaggagtcactgcctcttatcttttaagagaggttttttcatcattgaggcttgtgtttgtaagtgttagcagataaatctttgctgtattttctcttctcctccttttctcctcgagatttttattgtgggaatgtttttcaagttttactgtattctactgtttattgcttg

SEQ ID NO: 122 - DNA, 1843 bp, Eucalyptus sp.
ttttagttcgcttctccagcgccccattctctttttagggtttttcggcgatccagagaaacggtcaccgccggcgagagcttctgaaaccggcttacttctggccgagcaatatcggcagacgccgcgatgaaggtgaaagtgatatcgcgttccacggatgagttcacccgagagcgcagccaggacctccagagggtattccgcaacttcgaccccaaccttcggacccaagagaaggcggtggagtacgtccgggctctgaatgcagctaaattggacaaggttttcgcaaggccctttgttggagccatggatggacacgtcgattcggtatcgtgtatggccaagaacccgaattacttgaagggaatattttctggctctatggatggagatatccgcctttgggacattgcttcgaggcgaacagtatgtcaatttcctggtcatcaaggccctgtcagaggcttggcggcatctacagatggtcaaattctggtatcctgcggaattgatagcacggttcgattgtggaatgttcctgtagctactcttggggagtctgatggcacacatgagaacttggcaaagccactggcagtttatgtatggaagaatgcattctgggcagttgatcaccaatgggatggcgaactttttgctacagctggtgctcaagtagatatttggaatcaaaacaggtctcagccaataagcagtttcgaatggggaacggataccgtcatatctgtaagattcaaccctggagaacctaatgtattggcaacatcagggagtgaccgcagcataaccctctacgatttgcgtatgtcgtccccaacaagaaaagttatcatgaggacaaaaactaatgctatttcttggaacccaatggagccaatgaacttcactgctgcaaatgaagattgcaattgctacagctacgatgctagaaagttggaagaagccaaatgtgtacacaaggatcatgtttctgctgtgatggatattgattactctcccactggccgggaatttgtaactggatcctatgatagaacagtaagaattttccagtataatggaggtcacagtagggaagtttatcatacaaaaagaatgcaaagggtattttgtgtcaagttcagttgcgatgcgagttatgtcatatccgggagtgatgacaccaacttgaggctttggaaagctaaagcctctgaacagctgggagttgttcttccaagagagcgccgcaagcatgagtatcatgaagctgtcaagagtcgatacaagcacctccctgaagtgaagcgtatcgtgaggcacagacacttgcctaaaccaatatacaaggcaggtattctaaggcgcaccgtgaatgaagcagatagaaggaaagaagaaagaagaaaagcacacagtgcccctggatctagttcagcagagccattacgtaaaagaagaatcatcaaagaaattgagtgatgcttcttcttttagcgtgttgtgctgcatggcataatatttgcatttctcaaatctgtattgttggatggggctctatctttctcaagaggctgcttttgagtgaaaagttaacttcacctgagagatgagatagggcgacgatgcacaagctcctttcagtcttaacaattttggtagaatacggcggtcctttcctatgaagggtggcccgagagttagccaatgtttggtcacgccagcttttgcctggagcatcacaagtagtcagtttctgatctattggcgatttatcaagacatgatttgtttgtatcataagctttgatctttaacttgagttcaaaaaaaaaaaa

SEQ ID NO: 123 - DNA, 2129 bp, Eucalyptus sp.
aagcataaaccctagcaatcagacatcccaaaaaccctctctgctcaacccactcgatcctcttccccagggatcccgggaaccctaagagagccgccggctccaactaccgtccatgtacgatccatactagatctgaccaactgtccgccgttcaccggggcttcggtcgccggctcccctgtcatcaggtcaccaacttccttgaccttccggcactgttgccagtcgcgtttctctgcacgcgtaccatcgaacgaccacgaggatggttcgaagcataaagaaccccaagaaagccaaaagaaagaacaagggatcaaagaacggagatgggtcgtcttcgtcttcctcaattccttcaatgcctacgaaggtgtggcagccaggcgtggacaagttggaggaaggagaagagcttcagtgtgacccgtctgcttacaattcccttcatgccttccacatcggctggccttgcctcagttttgacattgtccgtgatacactgggtttggttcgcactgaatttccacatcaagtttactttgttgctggaactcaggcagagaaacctacttggaactcaattgggatatttaaagtaagcaacattactggtaaaaggcgtgaactggtgccatccaaacctactgatgatgccgatgaggagagtgacagcagtgatagtgatgaagatagcgacgatgaagttggtggatctgggacgccaattttgcagctaagaaaagtaggccatgaaggatgtgttaatcgaataagagctatgaatcaaaatccccatatctgtgcatcttggggagactctggacatgtgcaaatatgggacttcagctcccacttgaatgcattggctgaatcagaagcagacgtcagccagggagcttcctcagtttttaatcaggctccattagtgaagtttggcggccacaaagatgaaggttatgccttagattggagtcctcttgtacctgggaggctcgtatctggggactgcaagaatagcatccatctttgggaaccgacatccggttcaacatggaatgttgattccactccttttattggacatgctgcaagtgttgaagatcttcaatggagccccacagaagaaaatgtctttgcctcttgttcagtcgatggaactattgcgatatgggatacccgtttagggaagacaccagctgcttcttttaaggcacatgatgctgatgtgaatgtgatctcatggaacaggctggctacctgtatgttggcatctggatgtgatgacgggacattttcaattcatgatcttagattactcaaggaaggtgattctgtggttgctcatttcgagtatcataaacacccggttacctcaatcgaatggagcccacatgaagcctccacattggcagtatcatcggctgactgccagctcacaatctgggatctttccttggaaaaggatgaggaagaggaggcagagtttaaagccaaaacgaaagagcaagtgaatgccccagaggatttacctccgcagctcctctttgttcaccagggacaaaaggacttgaaagaactgcattggcatgctcagattccgggaatgattgtatctactgcagcagacggctttaacatcctgatgccctcgaacatacagagcactcttccttcagatggtgcctgaaattttgaccgagaccgaacaatacccaacacccggcctaatttttcaaagaacagaggcctaagggctgtccaaccatggagtcgcacaaaccgcagtgcaaatttctgtgtacattgtgatgcaatgatgagcaagtttgagacagtagatgatgcagcaacatatcgtgctcataactgcgagttgcgtctttttttttttttttttcttttttcgtttgtacggttcgtcttccttgctatgcttagctttgttgtcccgcccttgtaatgttttccccatgcgaaggtttctgggaattttcagtagaaaattcggtcgtggcggccatcctcgatattttggaatgtttggtaacttgagagatttttttatcatgagcatgggcataagtttaatgcacatacggatactttagagtcaaaaaaaaaaa

SEQ ID NO: 124 - DNA, 2800 bp, Pinus radiata
gggtcatggtcatcgctctcatactgcccaggtgaaggaaagcgctaagcataagcatataccataagcatataagcaaatgggtcctatccaaaatgcaagaggttggaagccttggaggtcatggtcaccgctctcatactgcccaggtgaaggaaagcgctaagcataagcatatacctttggcacctcctcctttaatggtcatgcaaataatcacggtgaaggaagctgaatctatatgaagagatattggcttgcatagtcacggtgaaggaagctgaatatatatgaagagatattggcttgcatagtcacggtgaaggaagctgaatctatatgaagagatattggcctctctagattgtcttgggtttgaacattctattataagcaatccatgcagtggaactccttcaatggtcatgcaaatggtcacggtggaggaagctgaatctatacaaagggatattggcttctttatattggattgggtttgaacattctattataagcaatccatgcatagagcttcagaacattaaaagcttacaatcttatcccatatcctttatatctatcctctccctctttaatttcgcccctgtaattcctttttctttctctggtcttttgatctagtgtttgaggagaatggtttagagcaattaggcatggagaatttcattcgcttccatggagagcttcacggggatttcagagctttagatcgtttccggtttcaggctataattataaggtattttttttaaatagatcgagctatttgaaaaggccatggagtggggatttaatcacattacaacccagactcctcttcaggttaaattgcatgccactgcattggaaattgcagtggaagagttgccagataaactggtttttagtggatgattgtcgaggtgctgcagcttataaaggctgcactcaatgatgccgatctactctttccttctagaactccagagttactgttattcttgttttactagggtggacttttgtggttgtgcttccttttatctcagtggatggtaccaggtcatgggtttaaagaattatctgcagagtgttcgctgtcaattttcaagcagtgttttaccagcttgttgatctcctatttgattatctagacaaagccatggagcgttacaaggtcataaaagagttgggggatggcacttatggaagtgtatggaaggctttgaatcagcagacacatgagatagtagctataaaaaaaatgaagaggaaatattatatctgggaagagtgtatcaatctccgggaggtcaagtctctgcggaagttgaaccatcccaacattatcaagctgaaggaggtcattagggaaaataatgaactctttttcatatttgaatacatggaatgtaatctgtatcaaataatgaaagagagatctactcctttttcggaaacagcaattatcaaattttgctatcaaatactgcaagggttatcctatatgcacaggaatggttattttcaccgagacttaaaaccagagaatttgttggtaactagcgacttgattaaaattgcggattttgggctggcaagggaagttctcactagcccaccttatacagattatgtttcaacaagatggtatcgtgctccagaagtcctgctgcaatctccgacatacactactgcaattgacatgtgggcagttggggctatactggcggaactcttcactttgcatcctctctttcctggtgaaagtgaactggatgaaatttacaagatctgtggtgtgcttggcactccagattatgagacttggcctgacggcatgcagcttgcagcttttaggaacttcatctttccccagtttctaccagtcaatctttcagttcttattccccatgctagcccagaagcaatcgatttgattacgcgtctatgttcttgggaccctcagaagaggccaacagcagagcaggcactgcatcatcctttcttccgtattggcatgtctattcctctttctcttgggggacatttccaagataatacatgtgcagcagaggtagatacaaattttcattccaaaaaggcatgcaaggggcgtggaatgggggaaaaagaatcaagcttggaatgcttccttggtttgtctttggggctcaagccaagccttggtcatctgggcgcaatgggatctcaaggtgtgggagcagtgaagcaggaagtggggtcctctccagggtgtcagagtaatccaaagcagtccctatttcaggttttaaactcaagagcaattctaccactattttcctcaagccccaacctgaatgtggttccagtcaagtcctctctaccttcagcatatacagtaaacagtcaagtcatgtggccaacaatagcaggtccacctgctgctgcagttactgtttctactctacagccaagcatactcggcgattttaagatctttggaaaatccatggggttggcttcacagtatgcgggaaaggaagcttcccctttcagctagataatcaaatttagttcatgctttctgaacaaagtaaatttttaatgagtgaaattcaccattttaagctgatagctttagttcctacgtggaatgtataaatgcaccattgtccataaggcaagagctttaatctggattccagtatatatacccagtttggtttctaaattcatttgtaaatagttccaaccgagagaggatatttttgaggtagattggcaatggaattactgcttgccattaaaaaaaaaa

SEQ ID NO: 125 - DNA, 2372 bp, Pinus radiata
tgttcaatttaattggatgtgaaagtcatttgcaggttctttgcttaacgaacgatcgtgtcacgttagtgtcagcgctgtgtgaagaatgagtttgaggcgaatatataaatggaattataaacgccagctgaactgaaagcattcagtcatgggcgagatgggtaggggcatcaacaatagcagcaataacaataatagcaacaggccggcatggctccagcattatgatttggtgggcaaaatcggggagggcacctacggccttgtatttctcgcgcggagcaaattacccaataacagaggtctccgcattgcaattaaaaagttcaagcaatctaaggatggggatggcgtttcccccactgctatcagagagataatgctactcagggagttttcccatgaaaatgtcgttaaactcgtgaatgtgcatataaatcacgtagacatgtctctgtacttggcatttgactatgcggaacatgatctttatgagattatccgacatcatcgggagaagctaaatcatcataacattaatcaatacaccgttaagtcactactctggcaattattgaatggattgaattatcttcacagtaattggattgtacatcgtgacttaaagccatctaatatcctggtgatgggtgaaggtgaagagcacggggttgtgaaaatagctgattttgggcttgccaggatataccaggctcccttaaaacctttatctgataatggggttgttgttacgatatggtatcgagcaccggagttactcttaggggccaaacattacacgagtgctgttgatatgtgggctgtaggatgtatttttgcagaactgataacactgaaaccactgtttcaaggtgtggaggtcaaagcttcaccaaatccttttcagcttgaccaacttgacaagatatttaaggtcttaggacatccaacaatagaaaagtggccaactctaatgaatctaccacattggtcaaagaatttgcaacaaattcaacagcacaaatatgacaatgcagggttgcatattggtcccattcctgcaaaaagccctgcttatgatcttctttcaaaaatgcttgagtatgatccccgcaagcgtatcacagcagcacaagctttggaacatgagtattttcgaattgatcctcaaccaggacgcaatgcacttgttcccagccagcctggcgagaaagctattaattatccacctcgtttggtcgacgccaatacagattttgatggaacaatcgctcctcagccttctcaggtatcttctgggaatgcaccatctggttcaattgcatcagctgcagtacctgctgttagaccacttcctcagcaaatgcagctaatgggtatgcaaagaatgcagaatccaggcatggctgctttcaacttaggtgcacaggcaagcatgtcaggactcaatcacaacaatattgctttgcaacgtggttcttctcaacaacaagctcatcaacaggttcggagaaaagaacccaatagtgggtttccaaatacaggatatccaccaccaccaaaatcaaggcgcttataaggatgaacttcatgtggaaagttgtataaaatgcatgtgaagtcacttcatatgtcccttggtacggctgccaagcacttcatcctctaatcagttggtgtcttggatgttgtcaatccaacatgtgaggccaggccttgatgttggccatatatggtgctgattggtgttcaatggctggactaagagactcttgtccaaatttaacaagaggctatattctctctcccagagaggtccttgcctatgccagaaatttcaaaatgatgtcagccaattcatcaggttatatttctgaattagcagaagcattacatgaatacctgttacctgatggaaactaatttttacctgatggaatggagtgatcagattaggcatcctttagggatttgtatggatttaagaacgcagatccttggatgctctggttacatgactactccttagggaatcagtcagacattttaaataacttccatatctttgaaggttcttttctcttcaggcagtagatacccaattatataccaaccttgtattaattgctgagcattcagcatgacttcatttttcttcagacgtttaggtatcatatatgttttgacaataaataatgtgcgtatgattctttggatgccctggatataagaccagttataagactacctaccctggggtaacttgtcatgcatcattaaccttgatatctttgaaggttcttttcatcttgggcaatgggaccccaatcatataacaagttatgattagttgtgaagcaaaaaaaaaa

SEQ ID NO: 126 - DNA, 1637 bp, Pinus radiata
ggtggaatttccattcaacactggaaaaactccaaatcaaaggtcagatatcataacctatatgctacaatgggattatatagattaataatgaataatacagccctgaacccaattctgttcaaaatttgaaacaatgctagctgttggatggagattgggtatttaaatatgggccgtcagatggggtttgaaacaaccacagcaacggttccattgagtttattcagatccattccatcgtcttacttttttttagctcagtggggtgggcagggtgtgtattgtgggctcgttggtggggtgaattgattacagaggaagcccaggaaggcactggaagcatttcaatataaataatctctgcaattgattgaatcggcccgccatggacaagtatgaaaagcttgagaaggtcggggagggcacctatgggaaggtgtacaaggcaagagacaagatgactggacagctcgttgctctcaagaagactcgccttgagatggacgaggaaggcgtcccacccagttctcttcgtgaaatctccctcctgcaaatgctgtctcagagcatatatgttgttcggttgctttgtgtggagcatgtgacgaagaagggaaaaccactgctttacctagtcttcgagtaccttgatacagatctgaagaaattcatcgactatcgacgcagtgtcaatgctggtcctctgccgcaaaatgttattcagagtttcatgtatcaactgttgaaaggtgtagctcattgtcacagccatggagtgttgcacagggatttaaagccacagaatctattggtcgataaaagcaaaggcttacttaaagttggagatctgggacttgggagggcttttactgtgcctttaaagtgttacacccatgaggttgtaaccctatggtacagagctccagaggtgttgttgggatcaactcactattccacacctgtggacatttggtctgtaggatgtatttttgctgaaatggtgagaagacaaccacttttccctggggattgtgaaatacaacaactgcttcatatcttcacgttgcttggaaccccaactgaggaaatgtggcctggagtaaaacgtctaagggactggcatgagtatcctcagtggaaacctgagaaccttgctcgggcagttccaaatctatcaccaactggtctcgatcttatcagtaaaatgctgcagtgcgatcctgcaaagaggatttcagcgaaggcagctatgaatcacccttactttgatgatctggacaagtctcaattctgaagtattcaaatttcactatttatgggtgttcaaggatgccagagacttttaggtgatcatagttaaggaaccgttcctgccaatttggaggtttaagcagccatagtaaaatagtttttcttgctatagattgcaagtctcatctgttgtttgcaaaagcaaacagaaattccaatttttgcagttgattctactcagcctttcattcattttttcattaagcggtactggcagaggacatgtctatttatacaagcaaatggtcctattggctgtttaaaacagttctatttaactcgatcaaaatctgacttattttgaaattcttctaaaaaccaaa

SEQ ID NO: 127 - DNA, 1217 bp, Pinus radiata
gttcgtcccacccatatctctgaacaccagagtagcaatggatggttatgagaaaatggataaggtgggagaaggaacttatgggaaggtgtacatggccagggacaagaaaacagggcaactggtcgcccttaaaaagaccaggctagagaacgatggtgagggaattcctcccactgccctccgggagatttctcttctgcagatgctttctcaggatatctacattgtaaggctgttagatgtgaagcacactgagaacaagcttgggaagccccttctgtacttagtttttgaatacatggagtctgatctcaagaagtacatcgatagctatcgccgcagccacactaaaatgcctcctagtatgattaagagcttcatgtaccagctgtgccgtggagttgcttattgccacagccgtggcgtgatgcacagggacttaaagcctcataatctgctggtggacaaggaaaagggcgtgttaaaaatagcagatcttggactgagtagggcatttactgttcctgtcaaaaagtacactcatgagattgtgaccctttggtacagggctcctgaagttctcttgggggctactcactactcattgcctgttgacatctggtctgttggctgtatattcgctgaaatgtcccgaatgcaagctctctttactggggattctgaagtacaacaacttatgaacattttcaggttcctaggaactccgaatgaagaagtgtggccaggagtgactaaattgaaggactggcatatctaccccgaatggaaacctcaagatataagccatgctgttccagacttggaaccaagcggtttagatctgttgtctcaaatgctggtttatgagccatccaagcgaatctcagctaagaaggcactagaacatccttattttgatgacctggataaatcacaattctgagtccctttaaggatttaagcaattcaggatagtttgtaggtatcaccattattatattgattggttaattgatttgtgcttttctgggggttctataaatggcctgttgtctgagaaataatctctgcaaacttgttggccggtaaataagtgttttgttgtgtttgcacaagcgaacggacaatgttggtcagacctcaaatattgtactccccacactagggagcatttacggtgaatataatttttcatattgtgtgtaaaaaaaaaa

SEQ ID NO: 128 - DNA, 1602 bp, Pinus radiata
ccactttcgaaaaacccgtttcaagcctttcacgaaagtccaacggtcagaaaattcaaaatgactgtttgaggcagagccaatctaggaccacactccatttatatatgccctctgctcctctcgacccttagagtcctctgcgaatcttgttgttagttactgtgtacgctgtaacaatggatgcctatgagaagttggagaaggtgggagaaggaacctatgggaaggtgtacaaggccaaggacaagaacacagggcaattggtcgcccttaagaaaacaaggctggagagcgacgatgagggtattcctcccaccgctctccgcgagatttcccttctgcagatgctttctcaggacatccacattgtcaggctgttggatgtagaacacacagagaacaagaacgggaaaccccttctttatttggtttttgaatacatggactctgatctcaagaagtacattgatggttatcgccgaagccacacaaaagtccctcccaatattattaagagcttcatgtaccagttgtgccagggggttgcttactgccacagtcgtggtgtaatgcacagagacctgaagcctcacaatctcctggtggataagcaaagaggtgtagtaaaaatagcagatcttggcctcggaagagcatttacaattcctattaagaaatatacacatgagattgtcactctctggtacagggctcctgaggttcttctgggggctactcactactctacacctgtagacatctggtctgttggttgtatattcgctgaaatggtcagattgcaagccctgtttattggagattctgaagtacaacaacttttcaagattttcagttttctaggaactcccaatgaagaaatctggccaggagtgactaaattcagggactggcatatctatcctcaatggaaaccccaagatataagctctgctgttccagacttggaaccaagtggtgtagacctgttgtctaaaatgctggtttatgagccatccaaacgaatatcagctaaaaaggcattggaacatccctattttgatgatctggataaatctcagttctgagatcgcttttaaggatttaagtaattcaggatagtatatataaattactgcatgcattggtggttttggaaatgtcccattttctacgaattcatctttgcaaaggaaaatatattagccagtatgtgtttcttttaatgtgtatgggcaggcaaacaagcaatgtttggttgctgttgtggaccttttaaatattgtattcccacactggagagtaactttctttgatgatctggataaatctcagttctgagatcgcttttaaggatttaagtaattcaggatagtatatataaattactgcatgcattggtggttttggaaatgtcccattttctacgaattcatctttgcaaaggcaaatatattagccagtatgtgtttcttttaatttgtatgggcaggcaaacaagcaatgtttggttgctgttgtggaccttttaaatattgtattcccacactggagagtaactttctttaaaattaatgttaagatgtgatattaaaaaaaaaa

SEQ ID NO: 129 - DNA, 1315 bp, Pinus radiata
gatcgatctatatctctgtgctataaacaaagcaaaacaatggattcttatgagaaactggagaaagtgggagaaggaacctatgggaaggtctacaaggctaaggacaagaaaacagggaaactggttgcccttaaaaagaccaggctggagaatgatggcgagggaattcctcccacagcccttcgcgagatttctctcctgcagatgctttctcaagatatgaacattgtcaggctgctggatgtggaacacactgagaacaagaatgggaagccgcttctgtacttggtttttgaatacatggactctgatctcaagaagtacgttgatggttatcgccgcagccacacaaaaatgccccccaagattatcaagagcttcatgtaccagttgtgccagggggttgcctactgtcacagtcgcggtgtgatgcacagggacttgaagcctcacaacctgctggtcgacaagcaaaggggtgtgctaaaaatagcagatcttggcctgggaagggctttcacagttcctatcaagaaatacacacatgagattgtgaccctttggtacagggctcctgaagtgctcttgggggctactcactactctacacctgttgacatttggtctgttggctgtatatttgctgaaatgtcccgaatgcatgctctgttctgtggagattctgaagtgcaacaacttatgagcattttcaagtttctaggaactccaaatgaaggagtttggccgggagtgaccaaattgaaggactggcatatctatcctgaatggagacctcaagatttaagtcgtgctgttccagacttggaaccaagtggggtagacctattgactaaaatgctggtttatgagccctccaaaagaatctcagctaagaaggcattgcaacatccttattttgatgacctggataaatctcaattctgagattccttttaaggatttaggcattttaaggatttgtcatatttgggggttttggagatcttccatttctgagattttcatctttgcacaaaggcaaacataagcccatataaataacttgaagtgtttgcacaagcaaacaagtagtgggagctttcccaaatattgttttcccacacctgggagcttttgtcatgagcatttatgctcagatttaacatggcccttcatgcttaaacctgttgttgtttgaaaataattttagaaaatgtgaagttgaagcatgttttgaatttatggtggtggcatgtggatatttgaacttggttgagaaaaattgaaacatctttgttagggaaaaaaaaaa

SEQ ID NO: 130 - DNA, 2103 bp, Pinus radiata
taatacgactcactatagggcaagcagtggtatcaacgcagagtacgcgggggtattccagatatctatatgtacggaacaccctccccgccgagaaaattaaggatgatcgtcgactgcgtaagaggcggcaaaattcgaaatttgtttatatcatcgctattcagatgcatgcctgcactagcttacgagaaataaatttcttagctctgcatcaacaaactaaacatggagaaatacgagaagttagagaaggtaggggagggaacctatggtaaagtgtacaagggaagagacaaacgcactggaagactggtggccctcaagaaaaccccctttcaccaggaagagggcattcctcccactgccattcgggagatttctcttctcaaaagcctctcgcaatgcatatacattgtcaagttgttggatgtaaaggcttcatttaatggcaaaggaaagcacgtactgtttatggtatttgaatatgcagattctgatctcaaaaagcacattgatgcacaccgccaatgcaataccaagttgtctccaaggtctattcagagctatatgttccaattatgtaagggtattgcctattgccacagccacggggtgctccacagggatctgaagccacagaatattttggtagatcaaaaaatagggttgctgaaaattgcagatcttggacttggaagagcttgcacagtacctatcaagagctatacttttgaggttgttactctttggtacagagctcctgaagtgctgttgggtgccaagcgctattctatggcattagacatatggtctcttggttgcatctttgctgaactatgtaatctgcaagcactttttgctggagattctcaaatacagcagcttataaacatattcaggttgctgggaactcctaatgaacagctatggccaggtgtgacccagctaagcgactggcatgaatttcctcaatggaggcctcaagatctttccaaagtcgtgttcaatctggatccaaatggtgtggatcttctttctaaaatgttgcagtatgatcctgcgaagaggatctcggcaaaagaagcactagaccatccatacttcgacagtttagacaaatcacaattttgacatcagtttttttatccatggagttgattggaagcggttaaaaggcatgcatctgagtggtcagcataagcacataataaaggagaacaataggtaacttctgtactgttcatgaaacttaatgggaggaaaggttttccagtgttttctgacatctcgatttcagcactgaattgtggcattatataaattcagggaggttcatagagttgcatttttgcatctctcaaggctatttttagaaagtagtcattcctattgaagggtcaacctttaattttggctagcaggactgtataggattatatgcatacaagatgacaaataattgttataaatccacaatgtgaacagttatttttgatggtgccaatgaagctgtgcgcctatggaaaaagcatacagggcgacaaataattattacaagttcacaatgtaagacacttatttttgatggctactgaagctgtgcgcctactagaaatcgttgatatgctacacatggccagaaagcttaccataagatttcttttttggttaagattctggaatggtttaggaatctctagctagggagctaagccttaaatatgctggcaattgttgtaattgtgaacaaacacaggcagtttccacattattattgtcatttatctttcaattcccatttggtcttcaatattatttagtaatttccttgtgtaaactacgttgtggtgatcttctacctggcagtcattagggatatagaagtcaacaggctaaggccggattctgcatatctttttccatcttagaatgttattaaacttggcctcatccaaaggactcggtatatttgagggaatcgcaaggaccctgcccctagtgggaagagcttttggttggtgaaagatgccattcccaactgcagagtgatgtaaggtttgaatcacttagtgaaagattctcattaacttaaaaaaaaaa

SEQ ID NO: 131 - DNA, 3172 bp, Pinus radiata
atttgttttctcttttgggtttaaattccatgttttcgaggattttttgggggttttagggttgtcagacgagcgcttttggagtgggttttgtaattattctaatggggtgcgtttgcggcaaaccctctgcgagggccgcggattatgtagagagccctgcagagaagggggcatcctccaatagccgatcttcttcaatggcgtctcggcggttggtagcccccgctgtcatggaccagggcattgatgccgagaacggacacgagggggattataggactaaattgagaggaaaacagagcaatggtgctgacccagtttcattgttgtcggacgacgctgaaaagcaacggcactctcggcaccatcagcatcagcagcatcatcctattcgtcctcatcatctgcggccacagggggaattcgttcccaacgccaattctaatcccaggttcgggaatcctcccaggcacatcgaaggcgagcaggttgctgcaggatggccagcctggcttactgctgtggctggcgaagcgatcaaaggctggatcccacgccgggccgactcttttgagaagctcgataagattggacaaggaacttacagcaatgtgtataaagcacgtgatttagatactggaaaaattgttgccctaaagaaggtgcggtttgacaatttggagcctgaaagtgtgcgctttatggccagagagatacaggttttacgtagacttgaccatccaaatgtagtgaagttggaaggattggtcacatcaaggatgtcctgcagcttgtaccttgtatttgaatacatggatcatgaccttgctggccttgctgcatgtcccggtataaagttcacagaaccgcaggtgaaatgttatatgcaacaattgcttcgaggtcttgatcattgccatagccgtggtgtgctacaccgtgatatcaagggttcaaatcttttgattgacaatggcggtattctaaagatagctgactttggcctagctaccttctttcaccctgatcagaggcagcccttgacaagtcgtgttgtaacactttggtatcgacctccggaacttttactgggtgctacagagtatggagttgccgtggatttgtggagcacaggttgcatacttgcagagttgcttgctggaaaacctatcatgccaggaagaacagaggtagaacaactgcacaaaatttttaaattgtgtggttcaccatctgaagattattggaaaaagtcaaaattgccacatgcaactatcttcaagccacagcagccatataaacgctgtgttgcagagacgtttaaagattttccaccatcggctctggcactgatggaggttcttcttgccatagaacctgctgatcgtggaactgccacttcagcattaaagagtgatttctttaccaccaaaccactcgcttgtgatccttcaagtttgccaaagtacccaccaagcaaggagtttgatgcaaaaattcgtgatgaggaggcaagaaggcaaagagcagcgggaggaagagggcgtgatgcagctaggcgcccatcacgagaatcaagagcaattccagcaccagaagcaaatgctgaattagcaatttccatacagaagcggcgcttaagttcacaagggccttctaaaagcaagagtgagaaattcaatccccagcaggaagatggtgctgtgggatttcctattgagcctccaaggcctatgcatattggcattgatgcaggtgccacttctcgcatgtattctcaacaatttgggccttctcattctggtccattatcaaatcaaatttctagttcaatatggggaaagaatcagaaagaggacgagatacaaatggctccaggtcgtccatcgcggtcctcaaaagccacaatatctgatttcagaaaaccaggggcctgtgcaccccaacctggagcagatttgtcacatttatccagtttagtcgcaacagcaagaagtaatgctggtatagatacacataaggaccgtagtggcatgtggcaacataatcgtattgatgcaatagatggtgtacataataatgggaagcatgaatttcttgaagttccagaacatccaaacagacaagattggactcggttccagcagccagaatcatttaaaggtttagataattatcacttgcaggatctgccagcaactcaccatcgcaaagatgaaagggttgctagtaaagaagctaccatgaactggcagggttatggtggtcaagggggggacaaaatacattactcgggcccattgcttccgccttctggaaatattgatgaaattttgaaagagcatgaacgacacattcagcatgctgtgcgtagagctcggcaggacaagggtagaccacagagaagcaatttatcacagaacgagaggaaagcatttgaacacagaagttttgtttctggggtgaatggaaatgcagggtattctgatcttgtaaatgaattgcccatttcagtaggtagtaataggttgaaagtgagcaagacaagagggactgaagaaatagttgagctgagggagttggagagggaacccctctcatcagtaatggagaagtatgaaagagagcatgaaatgtgatacctcctgtgtagtcttgtttttcttcattttaggttctgcaggtgagatagaagagatgagactgttctgctgtgcatatacctcaactggttaattgcatctcagaaagaactttcaacatctggttttgtatgaaagaggcagcggagttgagagcttaatttagtttaagctcaaggttcagagaattcttgcaggactgggacctggggtatttgaaaaacaacatataggttttccctatgaaaatgtacggaatttattgtattttagattctggagggccatctaaacttctggctgcttggtgcaacattgatggactgatatagttaaggtcttgacctttgttgcattttgctttgcatgcaaccatggttgtagatctcatgcatgtacgaatgtagaggacctggtctcaaaatgttatttgctgctttgttttacccttgaagtgaaatgcaggcaagcttcaccaaggtattccccctaatatcttttcagaacttttggattaaaaaaaaaaa

SEQ ID NO: 132 - DNA, 4048 bp, Pinus radiata
tctttccatactcaatgtttttccatactatggaattgaattctgttgaaaaatattgctaaatacaaaatagtattagtaataattattttaaattccgcttttattcgtatttataactattagccagcagagccgaacgcatgcaggagtctctctccttttgccttcgaaggtttcgctcagatgggctgcgtctgtgccaaacaatccgacattctcggtgaaccagaatctcccaaggtcaagggttcgaatctcgcctccagcaggtggtcggtctcctccgaaacaaaacaactgccgcaacattctgattctggaatcctgcatcatcagcattattaccaccctcgagacgaatccgacgaagccaaattgaaagagagcaactatggtggatcgaagaggagaacaaggcagggaagggatcccgctgacttggatatgggcatcttcgtccgcactccttccagccaatcagaggccgagctggtggcagctggatggccggcctggatggcagcttttgcaggggaggccatccatggctggatccctcgcagggcggagtccttcgagaaattgtacaagattggacaagggacttacagtaatgtgtataaagctcgtgatcttgataatggaaaaattgttgccctgaagaaggtacgttttgacagtttggatgctgaaagtgtgcgatttatggcacgagaaatactggttttacgcaaacttgatcatccaaatattgtcaaattggaaggacttgttacttcagaggtatcctctagtctgtaccttgtatttgagtacatggagcatgaccttgctggacttgctgcttgcccggggatcaagttcactgaaccacaggttaaatgttatatgcaacaattacttcaaggacttgatcactgtcacagacatggtgtactccatcgtgatatcaagggttcaaaccttttaattgacaatggaggcattttaaagatagctgactttggtctagcaactttcttttatcctgatcagaaacagctcctgacaagtcgtgttgtaacactttggtaccggcctccagaacttttgcttggtgctacagattatggagttgctgtggatatatggagtgctggttgcatacttgctgaactgcttgctggcaagcctatcttgcccggaagaacagaggtggaacaactgcacaaaatatttaaattgtgtggatcaccatctgaggactattggaaggagtcaaaattaccacatgcaaccatattcaagccacaacacccttacaaaagttgcattgctgaggctttcaaagatttctctccatcagctttggccttgttagaaactctccttgctatagaacctggtcatcgtggagaagcaagtggggcccttaagagtgaattctttacaacggagccgctttcttgtgatccatcaagcttacctaaatacccgccaagcaaagagtttgatgcaaaattgcgtgctcaagaaacaagaaggcaaagagatgtgggtgtgagaggtcatggatctgaggcagcaaggagaacgtcccgactatctagagcaggtccaacaccaaatgaaggtgctgaattaacagcattaactcagaagcagcattcgacttctcatgcaacttcaaacattggaagtgaaaaaccaagcactaagaaggaagattacactgctggattgcatatcgatcctccaaggcctgtcaatcattcttatgaaacaactggtgtttcacgtgcatatgatgcaattcgtggggttgcttattctggcccattgtcacagacacatgtaagtggttcaacatcaggaaagaagccaaaaagagatcatgtaaagggactttcaggtcaatcatctttgcaaccatcaaaaccttttatagtttctgactcaagatcagagagaatctatgaaaaaagccatgtaactgatttgtcaaatcattcaagactagcagtaggaagaaaccgtgatactacagacccacacaaaagtttgagtactctgatgcaacaaatccaggatggtacattagatggaatagatattggcacacatgaatatgcaagggctccagtttcttcaacaaagcaaaaatcagctcaattgcaaagaccgtcagcattgaaatatgtagataatgttcaacttcagaatacacgtgtaggaagtcgccaaagtgatgaaagacctgccaataaagaatctgatatggtatctcatcgtcaggggcagagaattcactgctcgggacctctgctgcacccatctgccaacattgaagaccttttacaaaagcatgagcaacaaatccaacaggctgtacgcagagcacaccatggtaaacgtgaagctctaagtaacaaatcatctctccctggaaagaaaccagtggaccatagagcttgggtttcttctggaaaaggaaacaaagaatcaccatattttaaaggaaaagggaacaaagaattgtcagatcttaaagggggaccaaccgccaaagtaacaaactttaggcagaaggtaatgtaaagtatagctaaggaaattgcagatgaagggattcagaaagagaacccctccagtcaggcacaaaaagatatgaacaaagaaaaatacttgctacatgtcttctagggtcatattctggtctctctagttgctgacgtcaatttatgcatggattggttgatttgggatgggagttttttattttctaagcactgggattgcttcagcgggcaaatcaataatcacgtaccttataaaatagggtatcctcaatttttttttctttatttataactgcgagggtttatgggatcttttaactctgcagaaaacttatacagggagtttcaaaccatcagataagtcttttgcatttaagattattgatcaccttctaaagaagtcacaattgtcttgcaactgcccattaaaacgttgaaggactatttggttttatctcgagatctctgtgatgcaacaactgactatatggtcactcttatgttgcagcgaatgcgaatggctctagccacattgtaatgatctgtttcagtattttctgtacagtggaagaataaagttatgccaaagttctttcaagaacttccattagacttttgtatttgttcatacatgattcgatagaataagaaatcatgcataagagactttcttttaagggaaacatctatgcctggaagattgagatgaagggttctattttaatagatatgggattggttgcaaatgtaaggagccaggttcttccattggcctggaggattttgtatgggacccttacatgctgctgatgaagacctatcacttggctatgcttggcattaaaacgaactgaaaagagaggcggcactgaggagtcaagccacatctgagaaaagactttaaattcagcatgcactcattgtgaagattgttattatgggtgagtcctaaatggttatgaacgctgtatttgtctgcaaggatagcgttcttgacaagggccaaatctttccatgtttggtttacagaagtttgtattttaattttgttcattgcattctgttgcagtgtttcaattgaatccgtgtcagaggaagcagcacaatatgtaggttttgtggagttaatcttttagttttaggaagcaaagttttctacatttcagagtagggctttccctctacagttttgagtgtagtgtgtttcttttatatcttgcaatcaaagaaatcatagctaatgattccatgctatccatggtatctacttcacgataataaaggtcttagtccacaagtttgatgtggtatacaatggagcaagagaattgcacaatgaatatcacatgaccttgattatttctaatgaacaataaatggtatggtggttttcattatgaaaacctcaaaacttttatatggagtatcttcataacattttaaatgagcaataaatgatatgcttcaaaacttttataaaaaaaaaa

SEQ ID NO: 133 - DNA, 2430 bp, Pinus radiata
gtccttcattgtttaaagccgattgatctatatttgttaagaacaaagaagattctgtacttctgcatatttatacaaatgctggagctcaagtattgattgcatcggagacaacccatctgttgaataggctgtgaatgtgccagcggaccttccctcgcttgaattttttcgtttagcagttgagtctgaggccgatttggaagaaagccgaggaggatggcagtcgcaaatcctggtcagctgaatctgcaggaggcgccctcatggggttctcgcagcgtcaattgctttgaaaagcttgaacagattggagaaggcacatatgggcaagtttacatggccaaggagatcgagactggggaaattgttgccctgaagaaaattcgtatggacaatgaaagagaagggttcccaataaccgccattcgggaaatcaagcttctgaagaagttgcagcatgaaaatgttatcaagttaaaggaaattgtgacctctccaggtcctgagaaggatgaacaagggaaatcagatggtaataagtacaatggaagcatttacatggtctttgaatatatggatcatgatctgactggtttagctgagagaccaggaatgcgctttagtgttccccagattaagtgttacatgaagcaattgttaatcgggctgcactattgtcatatcaaccaagttttgcaccgggacatcaaaggatctaatctgctgatcgataataatgggatcctaaagcttgccgattttggcctggcaagatcattctgcagtgaccagaatggaaacctgaccaatagagtaataacattgtggtataggcccccagagttgctgctaggctcaacaaaatatggtccagctgttgacatgtggtcagtgggatgtatatttgcggagcttttatatggaaaacctattttaccaggaaagaatgagccagagcaactcactaaaatttttgagctttgtggatcaccggatgagtccaactggccgggtgtttccaagcttccatggtacagcaatttcaagccgcaaaggcaaatgaagaggcgtgttagggaatcttttaaaaattttgacagacatgctttggatcttgtggaaaaaatgctcactttggatcctagtcagagaataagtgcaaaggatgcacttgatgctgaatatttctggacagatccggttccttgtgcaccaagcagcttgccaaggtatgaaccatcacatgattttcaaacaaagaggaaacggcagcaacaaaggcaacatgatgaaatgaccaagagacagaaaatttcacagcatcctccacaacagcatgttagactacctcctatacaaaatgctggacaaggtcatcttcctctaaggccaggtccaaatccaactatgcataatccacctccccagtttccagttggacctagtcattatacgggaggacctaggggagctggtggacagaataggcatcctcagaatatacgcccactccatgcagctcaagggggaggatataatgcaaatcgaggatatgggggccctcctcaacagcaaggaggaggatatcccccacatgggatgggaaatcaaggaccaagaggtggacaatttgggggtagaggtgcaggctattctcaaggaggtccttatggtggacctgtcgggggccgaggtccaaatgttggtggaggcaatcgaggtccacagttttggtcggaacagtgaatcgattgtggagtacacatttagcttgcatgtgatactattaaatgcaagtgtctttagtttgaaattgtgaaatcatccgagcatggccggatacacctttttaaattcaggaattattcacttgatcagtacgttctgctcacccctacagcaaagctacagttttttcttacatctaagatttttcttctttttagcggggttacaaacccaacaggtggtgttccttatggctgtcaagcatacatgcagcagctcattcagcctactgatttgggtggtgcatatgctcattactccattacagggattcaaatgccaaccatgtcaccacctaccacctaataggcctgagtattgctcaccactatgctgatatggggagcaataacgttagtaaatttgtgaattttgaagattttcttctagcaagtcatattgttggggcctgttaaatgaactttctggtgtatccggacaatttagggatgtgtgtttcgattactaccaaatgtacattagaatgccattttcttgatttaggttgtttttttaagaagtgaccaaattcactttgacattgtcttggctaatcatgatgactgatattctctctgtattatttaaagacaactctccagaaatatgactcgaagggattccgtaagaaaaaaaaaa

SEQ ID NO: 134 - DNA, 2101 bp, Pinus radiata
cttacagttttgacattctcataacgggaatgttcgaactgttaataccatttaatcaccgagtgactttaacgccatttcagtcagcaaagatttctcaatttgtttatcagaattgggtcggttcggtcataactcctgcatttcttgtttgtgtttgatctataaggctactcagatgttaaatatatttgattcagtctactctgttctgagggcaaatgaaactctccgggcttatgaaggttggtttgaattgaggaatttgggatatataaacactggcaatgttctccggaccatggaattgggggtttctccatagggtgtttcagggttttgagacttgaatacctcgaaaagatttgatgcgcgggttttgagaggtaaaatctcgaaaagatttgatgggaacaggtcttccggagatttgaggaatgcaaaacatggaggacaatgtgcagagcagctggagtctccacggcaacaaagaaatatgtgcccgttacgagattctagagagggtcggcagcggaacttattcggatgtgtacagagggcggagaaaggcggacggtctaatagtagcccttaaggaggtgcatgactatcaaagctcttggagagagattgaggcactgcagaggctttgtgggtgccccaatgttgtgaggctctatgagtggttttggagagaaaatgaagacgcagttctggttttggagtttctgccttccgatctctattctgtcattaagtctggtaagaataagggagaaaatggtattcccgaggccgaggttaaggcctggatgattcagatcttgcaagggctggctgactgccatgccaattgggttatccatcgtgacctaaagccctctaatctgctgatttcggctgatggaattctcaagctcgctgattttggacaggcaaggatacttgaagagcctgaagcgatctatgaagtagagtatgaacttcctcaagaggatatcgttgctgatgccccaggagaaaggttgatggaggaagatgatagtgtgaagggagtgcggaatgaaggggaggaggattcatccactgcagttgaaactaattttggtgatatggcagaaactgcgaatttggatttgagctggaaaaatgaaggtgatatggtgatgcagggattcacatctggtgttggaactcgatggtacagagctccggagttgctctatggagcaacgatctatggaaaagaaattgatttgtggtcgttaggttgcattctgggggagctcttgattttagaacctctcttttctgggacttcagacattgatcaacttagcaggttggttaaagttcttgggactccaacagaagaaaattggcctggatgctccaatcttcctgattataggaaactttgttttcctggtgatggaagccccgttggtctgaagaaccatgtccccagttgctcagacagcgtgttttctattttggaaagacttgtttgctatgaccctgcagctaggctaaatgctaaagaggtacttgagaataagtattttgttgaggatccttatcctgtccttacccatgaattgagagttccctcacctctgagggaagaaaacaatttttcagaggattgggcgaaatggaaggatatggaagcagattctgacttggaaaacattgatgagttcaatgttgttcactcaagtgatggtttctgcattaaattttcataaactctaattggctgatcatgtttcatcttcctcaaattgccttttatatggattagtattctaaattagctttgggggctgcatgtcttcaagcattcaccacgacagtaaagtaatcattatgattactgatgtattgctgtcactgggtgagaaacattatagccatgaacctgctgttaaatttgtagaattgtcttatacttgctcaaaatagtgactgcatgtttgagaataaatttctctgcaaagaccaactccaaattctttcttttcactttgtactaatgatcattgtgaccacaaaatctttatacacaatacagaaaatgcaaatttagagaaaaaaaaaa

SEQ ID NO: 135 - DNA, 1944 bp, Pinus radiata
ctccggcacagaaagccaagatgttgatcgcctcccacgctcgcacttgaccgttctcacgagaaatctcatgtccattccttccgtgcgagccgacagaggaccccaagagaagcacaatatttttgctataactaataatgccattaacatccgctgttgggacgcccggaagtaaatgatccatcgttgcgcgaagagcaaagtcagttaaagcgctaacaaccatatcagtaacgatggacttgaaccagtaccctgaagacttgaacccggaactacccgagggtacagacaacgtagataatcctgataataacaaaggctcccctgttccttctccccatcctcctctgaagccactcgatccctctgaacggtaccgcaaaggtatcacccttgggcaaggtacctatgggatcgtctacaaggccttcgatactgtgacaaacaaaactgtggcagtaaagaaaatccatctgggcaaagccaaagaaggtgttaatgtaactgctttaagagaaatcaaattattgaaggagctttcacatccaaatataattcagctaatagatgcatatccacacaaacagaatttacatattgtctttgaattcatggagactgatcttgaggctgttataaaagacagaaacttagttttctccccagctgatataaaatcctatttgcaaatgacgttgaaggggcttgctgtttgccataaaaaatgggttttgcacagggatatgaaaccaaataacttgttgattgctgctgacggccaactgaagttaggagattttggcctggctcgcttgtttggtagtccagaccgcaaatttactcatcaggtttttgcagtttggtacagggcaccggagttactgtttggagctaaacagtatggtccagctgtagatatttgggcaacaggttgtatttttgcagaacttctgctccgaaaaccgtttcttcagggtgtgagtgatctcgaccagatagggaagatttttgcagcctttggaactcctagacagtcacagtggccagatgtggcctctcttccagattttgttgaattccagtttgttcctgcaccatcgctacgttctttatttcccatggctagtgaagatgccttggatcttctgtcaaagatgtttacgttggatccaaaaaataggattactgcacagcaagcattggaacacagatatttttcttctgtgcctgctcccacgaggccagatttgcttcccaaaccctctaaggtggactcatcaaggcccccaaagcatgcatctccagatggtcctgtagtgctgtctccttctaaggcaaggcgagtaatgctctttccaaataatttggctggaattctaccaaagcaggtttcccaatctacaactggagggacaccaattgaatttgacatgccgacacaaaagctacgtgaagtttgccctaggtccagaattactgaatctggcaagaaacatttgaagaggaaaacaatggacatgtctgctgcattggatgaatgcgcaagggagcaagaagggcaagaaggtaaaaccattttggaccccgaccatcagcgttctgccaaaaaagagaagcatatgtaatttcacttgatttcactttgggtgatcatattgttaggcaaggagactaggcattttccttgtcactatcctcatattgatatcacctcgtgtatgttgtggggtggcaaaattacttccattattgttgatatcctttatgttgagaaggtggattcatttttaagcagtggtctcaaaaaatgaccctgcaagaactggaactgccaaatttgtaagcaatatactgttgagaaaaatgttttgcatcatcttgagttctcattatatgacaaatttcggaggagaaaaagattggtttctaaaaaaaaaa

SEQ ID NO: 136 - DNA, 1945 bp, Pinus radiata
gtaaagatcctctatctcttcccctatttgttcctcgccacagtacgttatttcggcgaaattcagatgatcggtctcaactattacagtgaccgccattactgtctgctgttcctgtgaatgacaaaaggttcttgatgtcaagaagttaagaagtcgtggaaacggattacgcgttaatgctgtttacaaggaaggattgctagtgctccgtctgttagcggatcctgttcttggtggggagattaaagatggcagggggacaggaaaattgcgtccgtattactcgagctcgagctgcctgtgtttcgaaagcttctgcccctgtgattcaatctcaagtagatgagaagaaatccaggaaaagagctcctaagcgagctgcagtggatgatcttgctgccaatgcaagcggttctcagcctaaaaggcgcgcagttttaggcgatgtcacaaatcttcatgctgctgctaccgattgcttgtcaacagcggaagaccaggttgatgctcccaatcctagcattaaagggagggcgcgtaacaagaagaaagaggcaaggacttcaacgaaagtagttaaagatgaaattcatccggaatcgaatcctcttgctgatcatagttcgaatctttcggaatgtcaaaagcctcccgctgcaaaattagcagagcaacgatcattaagaggcgtaccttcaaaggcaaagcaagggggaagctccaattcacaaagctgttcgaagcacacagacatagacaaagaccacacagatcctcaaatgtgtactacttatgtcgaagatatttacgagtatttacgaaatgcagagttgaagaataggccttcggcaaatttcatggagactgcacagaatgatatcaccccaaatatgcgagcaattctcgttgattggctggtagaggttagcgaggagtataagcttgtccctgacacactatacttgacagtatcttacattgatcgttatctgtccgcaaatccaactagtaggcacaaactgcaacttctgggagtctcttgcatgctaattgcctcgaaatacgaggaagtctgccctcctcatgtggaagaattctgttatatcacagataatacatacacaagagacgagatgttgtcaatggagagaaaaattttgatcttcttgaactttgagatgacaaagcctacaacaaagagttttctcaggcgttttgtacgagcttctcaagcagggaataaggccccgagtttgcatatggagtttttagccaattatttggcagagttgacacttatggaatgcagttttctccaatacctaccatccttgatagcagcctcaactgtatttctgtctcgattgacacttgattttctaacaaatccatggaatccaactttggcgcattatacaggatacaaggcatcacagcttaaggactgtgtaatggcaatctataatgtacaaatgaatcgaaaaggtagtacattggttgcaataagggaaaaatatcaacaacacaagttcaaatgtgtagcaagcttgcctccacctccttttattgctgaaaggttctttgaagacaccccaaactaaagctatccatcattggttgtgcacaagcgttttgctgaagcttgtttggaagtacaatctcatgtaatagttgtaattgaatccggagtcttttacttattgttggttaatttccatttagatgtgtcaatttgttcagaccgtcagtgcccattcttttggtgctcatattttaactcagcgacttaccagcctagtaagcaatggggagcttgcatgtattagttttgagcactcaaaggaagtgcccatttatcaaactgtatcatattttttggaaattattacgtggaaacagacgactccatgtggtcatggagtaatgattaacaaaaaaaaaa

SEQ ID NO: 137 - DNA, 2258 bp, Pinus radiata
gaaaggagggagtggtacgagcttcggaagaggagcttccaacccgacaccaaatcttctcacggggctcctctatatgtacagcaaacactggcgactctttccctcagttccgttggtcctactgacattagctggaacaggctgatcggccatggtgatcctttgggcgggctgcaagaactggtaaacttccgcggctggatctctgaatattgctgttcgatttacacatattcaaaggtgtaataaaaataacgatgactggaacccaggcatccaatgttcgcattacacgggcgagggctgcaaagtccacgttgaacaatgcccttcctcctcttccgccagcccaaggtaaaccgagaggaaaacgtgcagcaacggagtcaaatatttccggattcagtgttgctgctgaaccccttaaacgacgtgcagtgttatcagatgtgtccaatatctgtaaggaagcggccgcggttgattgcttgaaaaaaccaaaagcagttaaggttgtatctcagaatgccaatgccaagggaagaggccgaggaattcctcggaataacaagaagattactcaagaggcagagattaaaaaagagacttcaccagctatttgtaatgttgacgatgcatctgctggtaatgcaatcggggatgataagcaaaacaataatgtgaaccctctaaaagaagtacaggacaatcctaaagaacttaatccaattgctgagcaaatttcagtacacccacattgcaaacagtcagtggaaaaaccgaatgagaaagagattgtggtaagtgataataaagcagcaattgcttctctgaagcaacaatcaacattgcagtctctacgtataccaaaacaaccaaaatattctttgaagcaaggtaatcctgttcctctggcaaaccttcatgaagatgtgggacggtctagctgttcggatttcattgacattgattcggaatacaaagatcctcagatgtgtacagcctatgttacagacatctatgcaaatatgcgagttgtagagctaaagagacggcccttgcccaattttatggaaaccactcagcgtgatatcaatgcaaacatgaggagtgtactcattgattggcttgttgaggtatcagaggagtacaagcttgtcccagacacactttatttaaccgtatcttatattgaccggttcctctctgcaaatgtagtcaatagacaaaggctacagcttttaggggtttcttgcatgcttgttgcctcgaagtatgaagaaatttgtgctcctccagtagaagaattttgctatattaccgataatacctacaaaaaggaagaagtgttggaaatggaaattagtgttttgaaccgcttgcaatatgatctgacaacaccaaccaccaagacctttctcaggcgtttcatccgagcagctcaagcatcatgtaaggtttcaagcttgcatttggaattcatgggcaactatcttgcagagctaacacttgtagaatatgattttctcaagtatctaccatctctaatagctgcagcagctgtatttgtggcaagaatgacccttgaccctatggttcacccttggaattctactctgcaacattacacaggttataaagtatcagacatgagagattgtatttgcgccatacacgacttgcaattgaacagaaaaggttgcacattggctgcaataagggagaagtacaaccaacctaagttcaaatgtgtggcgaacttgtttccacctccaataatttctcctcagttcctcatagataatgaggtgtagttgattctgaatatgtggcactcatcttcatttggctacatctcaaatggatgcagatagctgtgtttttcagatttgtgaattgggaattcatcactgaaaaagaattcgtcctggtcctttaggacatgtacttatgtccatgcaagtgcttcttgcctaagctatgttgatatttcacctttctttagataaggtgcttggttgatgctgtcatataaatggccatgtctaccatgcacataaatttaaacattttcttgaaaaatcaagattatgactatgggtatcagtgaccacttttcacttgtattttatatgcagagttaatctggaggatcattatccatgagagtggcccattctgattttaaacaatgaacttacctggttgtctataacatttttagttaatattgaaatcatggcttaaaaaaaaaa

SEQ ID NO: 138 - DNA, 2027 bp, Pinus radiata
cttgaacaggaacagacagattgtttcaaggccacatgcagcagcaaacatagagattgtttcaaagccacctgcagcagcaaacagacagattgtttcaaagctaccttcagcagcaaacatacagattgtttcaaagccacccgcagcagcaaagggtcctgcaatggcagcacctaaccagaatgcgttattaatcaacaacaacaataggaggcccttagtagacattggcaatctagtgggagctttgaacgcccaatgcaatatcagcaaaaatggtgccaggaagagggccttcggagacattggcaatctcgtggaagatctggacgctaaatgcactatcagcaaatattgggttagaaagaggcctagaacaaactttggtgtcaatgctaacaagggagccagttctagcactcagggacagggtattgttgtcaggggagaacaaaaagcatgggacaggatagtctggggaaacaaacaaagctgtgctattaaaatgaatgctcaacacgtcactgctactcagaggggtactgccatttcaatcagtgatatcatagattcaagtgtacaagatgggggaataaaagcacctagccagctgaaagcaaggaaacaaacagtacgaacagtgactgcaacactaaccgctcgaagcgaggattcattgagggacgtccttgaggttcctcctggcattgatgatggagaccgagacaacccactggcagttgttgaatatgttgaagatatataccacttctaccggaagattgaggtcaggagctgtgtacctccagattatatgacaaggcagcttgaaatcaaggactccatgaggggagttataattgattggttaatagaggttcatcggacatttctactgatgccagagacattgtatctcactgtaaacatcatcgatagatacctctctattcagagtgttacaaggaatgaattacaattaatgggtatcactgcaatgtttattgcttccaaatatgaagaaatctctcctccaaagatcaacgatttagtctacatcacgaaagacgcatacacatcaaaacagatagtgaatatggagcatacaatattaaatcgactgaaatttaagcttacggttcccactccatatgtattccttgtcaggtttcttaaggcagctggtccagacaaagtgatgaaaaatctggcattcttcttggttgacctgtgtttgcttcattacaaaatgatcaaatacagtccatcaatgcttgctgctgctgctgtctacactgctcaatgcactttgaagaagcatccatattggaataaaacacttatccttcacattggctactcggaagcacacctcagggaatgcgcacacttaatggctgatttacacctgaaggcagaaggaagtaacctcaaaagtgtttataagaagtattcatatccaatttttggctctgttgcttttttaagccctgccaagatacctgcgggaacagttgcagctccagcaattgataaatgtgcacaccagatttacttgaggaaccttcgctgaaggttgcccattcttccgatcggtcgaaaacctatctctggtgatgtcgctaagagaatgttttcggttgtgtgtatgtaaaattgtagatagcccttgaacaagacatgtaaatttatggctgattatttttcatacattgagattctcattatattctgaacaactagttttcattagcaagataaatgctagatgctttgaactggcatagactgctaacatccccggccttcttaatttctaggcgatatatatcaccgtaactttggatttgtaaagaatataggggatcattagctttatgtaattatattttcaagtatgattcttcattcaacaatctttgttgatggatactttggttcataacatctctataagtgaatatggaagccaataggcttgtagttcaaatgtaattttgccagtctcgaaaattaaataggcc

SEQ ID NO: 139 - DNA, 1989 bp, Pinus radiata
ctagaacagtgaagaaatttgcgagcacaagatccctcgtttctgtggtcgttgtgatttcagtttatttggttgccagagctgccacccctggggctctgggatactgcctgattcaaccttgttatacagggttttataacttgtttcttgcgattagccagcaaatttaatttgcttaaatgttccccaacaagcaaacccaagggcttgtacagaacaagaagatggcttctaaggcagcccaaccaaaagcaatggtccctccccagagggttcctccagctgcaaacaataggagggctctgggagatattggtaacattgtggcagatgtcggtggtaaatgcaatgtcaccaaggacggagtcaatgggaaacctcttgctcaggtctctcgccctattacaaggagttttggtgctcagttacttgcacaggcagctgcaaacaaggggatctccgctgccaataaccaaactcaggtaccggttgtgattccaaaggcagatgtgcggggaaacaagcaaaggaggactagcaagagcaaggacattcctccgacaactgtagttaccaatgaatcagatgattgtgttattattgaacaagcacagagaataaaaccaacttgtaatcacaatgttggagctgtagggaacaaagagaaacctcaattactaacagcaaagcctaaatcactaacggcatcacttacatctagaagtgcagttgcgttacgtgggtttagatttgatgatgaaatgactgaggcagaggaggaccccttgccaaatattgatgtgggggaccgcgataaccagttagcggtggttgaatatgttgaggatatatacaagttctatcgtagaacagagcaaatgagctgtgtgccagattatatgcccagacaacaagagattaatcccaaaatgagagcagtactaataaattggttaattgaggtacattacagatttgggttgatgccagagactttgtatcttaccacaaatcttattgatagatatcttgctactcaacttgtatcgaggagcaactatcaattagtgggtgccactgcaatgcttctagcttcaaagtatgaggaaatttgggctccagagatgaatgactttcttgacatcttagaaaataaatttgagaggaaacatgtactggttatggagaaggcaatgctaaacaaactgaaattccatctcacagtcccaactccatatgtattccttgtccggttcctcaaagctgctgcctctgatgaagagatggaaaatttggtattcttcttgatggaactgagcttgatgcaatatgtgatgataaagttccccccatcaatgctcgctgctgctgcagtctacaccgctcaaatcactttgaaaaagacaactgtctggaacgatgtacttaaacgccatacaggctactctgaaatagacctcaaggagtgtacaagactgatggtggcattccatcagagttcagaagaaagcaaattgaatgtagtttttaaaaagtactcaatgccagagtatgactccgtggcacttatcaaacctgccaagctccctgcataggctttcgattggagttgcagttgcagagtgtgtagcaactgatgagcatagttgttatgtttctcaactcagttgcacatccagcaactgagattgatatgtcaatcaaaatttttaacatagaagatcattcattctcttgatattcccctttaggtggatggattttttggtcattctttgtaactgtacatagttgtggcaaaatcatgattaagagaagatatagcccacttcatttttggcataggcctgcccacatgggaagtggtggcttaaagccaagggattattacttgtcaattgtaataaatgcttgagggcatttatgtgttttttaatttaaaaatttgaattatagaacactgaaattgatttctcaaaaaaaaaa

SEQ ID NO: 140 - DNA, 1520 bp, Pinus radiata
gggcttttgggattcggagatgtgaagaaaatgaggtggggagggagtagataaccagaagaagatgaacaagatctggatttgataccagccagccatggcgccaagcttcgattgtgtggccaatgcttacatcgaatcctgtgaagaccaggagaagctcagacaaaatgcccaaatcttggcccagtctggtgagaacgatgttgatgaaccagtctccatgttggtacagagagagacccattacatgcttccagaggactatttgcagaggctccggaatcgaactctcgacgtcaatgttcgtcgagaggccgtgggctggattctgaaggtgcattctttctacaatttcggagctccaacggcctacctggctgtcaattacctggatcgatttctctcgaggcacagaatgccgcaaggtgtgaaggcttggatgattcagctcatggccgtggcctgcctgtctctcgcggctaagatggaggagacccaggttccactcccttcggacttgcagagggaggacgccagattcatctttgatgctcgcactattcaaagaatggagcttctgatcttgagtacattgcaatggggaatgcgctccatcacgccattttcattcatcgattactttgcttacagggctgttcaaggtcatggccatggccatgatgctactccaaaagctgtgatgtccagagccattgaactcattctcagtaccacagaggaaatagatttcatggagtataggccatcggcaatagctgcagcagccctgttatgtgcagctgaagaggtggtgcctctgcaagcagtccattacaaaagggctttgtcctcctccattactgatgttgataaagacaaaatgtttggatgttacaatctgattcaagagaccatcatagaaggaggctgctactggactccaatgtccctacaatccactgagaaaactccagtgggagtgctggatgcagcagcctgtttaagcaatacacccacctcaagctacagcgtgaagccatatgcctctgttacagcagccaagaggagaaaattgaatgaaatctgcagtgcattgttggtatctcaagcccatccctgttgacacagtacgaggtccccagcttcggttgtcgagattggagagtgggatttggtagggttttagtggagcagcagatgcaaaaccctatatagatatataatcgactgtaaatggggtatagagtacttagcctgcaaattgctgtcccttcctcgcctatttgaccaactggtttggcccagactggattttgtcttgttttagagaagggtttaattcagtttgaataatggaggatgatgatgacagatcacccataatatcagtgaagaaactcatacactggacaggccaaccttccaaatatgtgtttagaaaacctttgtcttctttttatgtcatacactcatccaatcaaacaggcccacctttccataaaaaaaaaaaaaaaaaa

SEQ ID NO: 141 - DNA, 1280 bp, Pinus radiata
gtttatgcaattccaatatttatcacattcacctcatatcatatatttgcgtattgtgacttctatacaacaaaaaacaggtaccagagcaggcacgaataacctgcaggtctatctatcttgttttttttaagacggggttgcagaatggcagcaaatttttggacgtcttctcactgcaaggaacttctggacgcggagaaggtaggaatcgtccatccgctcgataaggaccaggggcttactcaagaagatgtcaaaattataaagatcaatatgtcaaattgtatacgaacattggctcaatatgtgaagctgcgacaaagggtagtggcaacagctattacatattgcagacgtgtttataccagaaagagcttcacagaatacgatccgcagttggtagctcctacttgcctgtacctagcatccaaagcagaagaaagcactgttcaagctaaactagtaatcttctatatgaaaaaatacagtaagcatcgttatgaaatcaaggatatgctcgagatggaaatgaagcttctcgaagctcttgattactatttagtcatctaccatccataccgtcctctaattcagttcttgcaagatgcaggtttgaacgatttgaaagttacggcttgggctctagtaaatgatacatacaggacggatctgattttgacttatcccccttatatgatagccctggcatgcatctattttgcatgcattatggaagaaaaggatgcacaggcatggtttgaggaacttcgggttgacatgaatgagatcaagaacatatcaatggaaatagtggactactatgataactaccgagtcatcccagacgaaaagatgaattcagctttaaataaactcccacacagattttaaagtatcaagcatacctttgtattatggtgaaacccatttgaaagcattctatttctttttctcatttccattgtcatgggaaatatagaagactcgggctcttgtaaaagttgggaaggggtgctatccatatctagaatctaccatgctcaatgaggtatcttcattagtatactaattgaattccagttcatccctgtgttattcaagctttatggtaatttaaaaattactgcgtagtggaagcttgaaagcctagttattcaagtgacaatatttaaaaaggacaatcttatgtattttgtatttctgtattttacatataagaacacataatctataatcatcagataaaatattattgcgttgaacattaaaaaaaaaaa

SEQ ID NO: 142 - DNA, 1775 bp, Pinus radiata
ctggagttgtctgcattctcggagcttcaatcaatccatgctccatctcctgtgcagtttgaagtctgtgaaaccatctgttgaatgtgggattcaatagggcatttgggcacttgttctgctaatttgggggggccttggcggcggtgttatggagcgtaaactgatgtgcaaagggccttaaactatgctgccattcctgtattgttagcacactgaaaggggttttcatgggttttgattagatgagtagcagttgtaaaacattggtctgtgctgctaaattatggcccctgcactatcctccagctatgaatgcctgtcccatttgctctgtgcggaagatgccagcaatgtagtgggctgctgggatgaggatgagagtaaaatcttttgtgaggaagaagagggttttgggattcagcatttccctgatttcccagttccagatgatgatgaaataagggtcttagtgaggaaggaaagccagtatatgcctgggaagtcctatgtacagtcctatcagaacctcggactggatttcaccgcaaggcaaaacgccatcggatggattctcaaggtccatggctcttacaactttggtccactgactgcctatctgtctataaactatctagatcggtttctgtccaggaatccactaccgaaagccaaggtctggatgctgcagctcctatctgtggcttgcttgtctctggctgctaaaatggaggaaacccaagttcctttactcctggacttgcaggctgaagagcccgacttcctcttcgagccgcgtactatccaaagaatggagcttctggttctgagcactctggaatggcggatgctctctgttacaccgttttcgttcgtcgattacttcttgcagggtggagggggcaggaagccaccgccgagagctatggtggcgcgagccaacgagctcatattcaacacacacacagtgttggatttccttgagcaccgaccatctgccatagctgctgcagctgttatctgtgcagccgaggaggttttgcccctggaagcagcccagtacaaggagaccatcctctcctgctctcttgtagacaaggaatgggtgttcggctcttataatctgatacaagaagtcctgattgagaaattctcgacgcctaagaaggcaaaatcagcatcctcctcaatcccgcagagccctgttggagtgctggacgccttctgtttgagcaacaacagcaacaatacttcactggaagctagcttaagcgttaacctctacgcctctgtggctgccaaacgcaggaagctcaacgattactgcaatacatggcgaatgtttcagcacagcacctgttaatcaaacatgagattgaaggccaaggactcaaaaaccagtccagcatttgtgtgctgttttagagggttttaatacttcaagtcctctgtagaatttgatacctctggacgctacagtgatcagggatttgatctaatgctagtttattgatttctatgatccaagacctcgtcatagatcaagtgcctagtttattgatttttatgacacagtcgaagcttttctaagcttttccgagactcctaacatatgtaacaacagaattcgtgagccaagagaatttgttgaattcgttctctatacttattttgtaactctggacggaccagttaaattataaatcctggaagttttgatcaattatattcaaaatcaaaaaaatcctgcgttgaaggttctgtgaaaaaaaaaa

SEQ ID NO: 143 - DNA, 1592 bp, Pinus radiata
gctaacctgtagatatcctttgcttcccattccctctcatggatttggatttcccctgatttgattcaggacaaaagcccttgtggctcccctacaaatatgtatttgcatatctgaaatttccctggccataatagctgagaggctttttcttttttttctttcattcaatttcatggcggggattcctgagttgggttgttgatgaataacaggatcagcagctcaggggcccggggcttgtagggggatggcacccaactgcatagactgtgcccctagtgatctgttttgcgcggaggatgcttttggagttgtggaatggggcgatgcagagactggaagtttgtatggagatgaggatcagctgcattataatttggacatttgtgaccagcatgatgagcatttgtgggatgacggtgaacttgtagcttttgcagaaaaagagaccctctatgttcctaacccagttgagaaaaacagtgctgaagctaaagctaggcaggatgctgtggattggattttgaaggttcatgcacattatggctttggtcctgtgactgcagtgctctcaataaactatcttgatcggtttttgtctgcaaatcaattacagcaagataagccatggatgactcaactggcagctgtggcttgcctctccctcgctgccaagatggatgagacagaggttccccttctcctggactttcaggttgaggaggctaagtatatattcgaatctcgcaccattcagagaatggaattactggtgcttagtacccttgaatggcgaatgagtcctgtgacacctctttcctacattgatcatgccagtcgtatgattgggttggagaatcaccattgttggattttcacaatgcgctgcaaggagatactgttgaatacactcagagatgcaaagtttttgggccttctgccctctgttgtagctgctgcaataatgctgcatgtgatcaaggaaacagagcttgttaatccatgtgagtacgagaatcgcctgctcagtgccatgaaagttaacaaggacatgtgtgaaagatgcataggactactcatagcccctgaatcatcatccttgggcagtttctctttgggtttgaaaagaaagagcagcaccatcaatattcctgttcctggcagcccagatggagtgctggacgctacctttagctgcagcagcagcagctgtggtagcggacagagcaccccagggtcatatgattccaataactccagcattctttgcatctcaccagcggtgataaagaagagaaagcttaattatgagttttgtagcgatcttcattgtttggaggattagtagattaccataaatacaagtgctcctctatgaagaacgctttggaagcaagctttgctattaaaacttcatttcaactatacctatccagaattaagtgcaagttcaggcctataataggcaactattatagctctatgccattatgtctcgcatgggagaaacatattgttattaaataccattcaatatgcttatgattcatgaatgcttaagagattctgctgctgtgtgaaaaaaaaaa

SEQ ID NO: 144 - DNA, 790 bp, Pinus radiata
ttctgcccttgcgagctgcttagtttattcctcgttaacttcgtcctttcgaccttttacgcgccgtctcgttcgcccaatctcaggttctcgctcactaattttcgtttcaaagggttttatcagagctttccaccgctgtttgcagggcatttcaagttctcagggcggaattcgacctgtctgttatccgccagatcattcaagcctttagttcgctcgaccaggatgcctcaaattcagtactcagagaaatacactgatgatacctatgaatacagacatgtggttctccctccggaaactgccaaattgcttcccaagaaccgacttctcaatgagaatgaatggcgagccattggagttcagcagtctcgtggatgggtgcactatgccattcatcgtcctgagccacacatcatgttattcagaagacctttgaattaccagcaaaaccagcagcaacaggctggggctcaatctcaacctatgggtttgaaagcccagtgagttttattgtgggttgttgaaagcagtttcaatgttctgtttgaaactaatcagaataggttctccagggtgtttgactttttcctttgcaggtagttctgcagttttagtatattagggtgatgactttctttatcaaggctagtctgttgtttagttaatacggttgacaatgaatgtctagtacatatttttgtgaactattatgaactattgcttctaaactgtagaagcctgttatctttagactcgtggttatgtgaactacttttacagtaaa

SEQ ID NO: 145 - DNA, 874 bp, Pinus radiata
ggcgtgtcaatgtttcaataccaaatagcatttagaattatactgcagcgttttatctgatacacgaaggatttttaaatttgcctgtaaaatggatcaaatagagtattctgagaaatactacgacgatacctatgagtacaggcatgttgagcttccgcctgatgttgcccggctacttcccaagaatcgccttctaaccgagaatgaatggcgaggaatcggggttcagcagtctcgtgggtgggtgcactatgctattcactgctctgaaccacacattatgttattcagaaggcctttgaattacgagcaaaaccaccagcaccctgagccacacattatgttattcagaaggccgttgaactgccagccaaaccaccagccacaagcacatcatccaacataggctgtggggattcgagcctgatggttatgcactgtggccagcaagatgttgaagttttagctgagtaatttgaaagttccttttttccttttcaccatagctattatttgtgtacgtatttcccaggctatgtacagatttaaattgaaatctagccatgactatgggccttgagatatgactattgtatatgtatcccctatcttgtgaattgtgaaatttatatgtttttttcttctgcgaatggttcaaaattagacgaacagaaattttgttcccagtacagtaaagcccaaatgcaagcccaaatgcaagagggcggacgcaggcgttgtgggttacatcatgtcatgtaatttgtctgatcaagttctaaggctggcttggtatcaatgaacttttaacttctaattttgaagacatacatttattcttttaatttgatgtctttctgtgagtaaaaaa

SEQ ID NO: 146 - DNA, 933 bp, Pinus radiata
gttttatctgatacacgaaggatttttaaatttgtaagtgctcagtttttgcaggcctgtaaaatggatcaaatagagtattctgagaaatactacgacgatacctatgagtacaggcatgttgagcttccgcctgatgttgcccggctacttcccaagaatcgccttctaaccgagaatgaatggcgaggaatcggggttcagcagtctcgtgggtgggtgcactatgctattcactgctctgaaccacacattatgttattcagaaggcctttgaattacgagcaaaaccaccagcaccctgagccacacattatgttattcagaaggccgttgaactgccagccaaaccaccagccacaagcacatcatccaacataggctgtggggattcgagcctgatggttatgcactgtaagtgatctgatttgattaactattttatcaattaatttttcatttgaaattcaaccaatcaatttctctcgaccaattccatctctgtgcctgattcgtaggtggccagcaagatgttgaagttttagctgagtaatttgaaagttccttttttccttttcaccatagctattatttgtgtacgtatttcccaggctatgtacagatttaaattgaaatctagccatgactatgggccttgagatatgactattgtatatgtatcccctatcttgtgaattgtgaaatttatatgtttttttcttctgcgaatggttcaaaattagacgaacagaaattttgttcccagtacagtaaagcccaaatgcaagcccaaatgcaagagggcggacgcaggcgttgtgggttacatcatgtcatgtaatttgtctgatcaagttctaaggctggcttggtatcaatgaacttttaacttctaattttgaagacatacatttattcttttaaaaaaaaaaa

SEQ ID NO: 147 - DNA, 727 bp, Pinus radiata
cttttgcagtttaccgtagtctttcagcgtttctacttcaaagagactatttttgcaggccggaaagatgccccaaatacagtattctgagaaatactacgacgatacctatgagtacaggcatgttgtgcttccgcctgacgttgcccgacttcttcccaagaatcgcctgttgaacgagaatgagtggcgaggaattggggtgcaacagtctcgtgggtgggtgcactatgctatccaccgtcctgagccacacattatgctattcagaaggcatttgaattaccagcaaaaccaacagcagcaggcacaacagcaaccagcacaggctatggggcttcaagcctgattggttttatgttgtggcaagcgttgacaaaatctccttgttaaggattcttggattcttcccgagcaagcaggctttcgtacgtagtgttagatggttgatttttccatcataaaagtaattagaattaatgtgagagtcccatttgcatttaaaaaatggtcattatccgagatagtgcgctttgtcatgggaaaatgactattgaatgtgagtttcctttgcccagggaatatgtaaagggattttgaattctcatgtgaaaacggctattacatgtgaaaatggctgttatatgttcaaagtgatttcgaattgatttttgttacttcaggaatgaaattatttctatctttttttgcttttttaaaaaaaaaa

SEQ ID NO: 148 - DNA, 2187 bp, Pinus radiata
ggctacgcgaactgaacagtgacaaaatatcactcggacgccatgctctgcaagtcattcaaaactgtgtaaaaccgtaaaccatccctctgtcctcaaactgtaggtcgcctcgattgctgtcatggcgctggtagaaacggagcctgtaaccttaatacacccggaggagcccaaaaaattcaagaaaaagcccactccgggccgcggcggtgtgatttcccatgggctaacagaggaagaggcaagggttaaagccatagccgagatagtcggagcgatggtggaaggatgccggaagggcgaggacgtcgacctgaacgccctcaaggcagcagcatgccggcgctacgggctatcgagggcgccgaagctggtggagatgatcgcagctctgcccgatggcgagagggcagcggtgcttcccaagctcaaggccaagccggtgcgtacggcctcgggcatcgccgttgtggctgtgatgtcgaagccacatcgttgtccgcacatcgccaccactggaaatatatgcgtgtactgccccgggggccccgactcagatttcgaatacagcacgcagtcttatactggctacgagcccacgagcatgcgtgccattcgagccagatataatccatatgttcagacaaggagtcggatagatcaattgaagcgactgggtcatactgtggacaaggtggagttcatcttgatgggagggactttcatgtctttgccagctgactatcgcgattatttcattcgaaatctgcatgatgctttatctggtcacacctcttcaaatgtggaggaagctgtgtgctattcagagcacagtgccactaaatgtattggcttgactattgaaacgagacctgattactgtcttggacctcatctaagacaaatgttatcatatggttgcacacgtctagaaattggagtccagagtacttatgaggatgttgcacgtgacacaaataggggtcacactgtggctgcagttgctgattgcttttgcctggcaaaggatgctggtttcaaggtggtagcacatatgatgcctgacttgccaaatgttggtgtggagcgagatatggaaagttttcgggagttctttgagaaccccgcatttagggctgatggtcttaagatctatcccaccctagtaattcgtggaactggactttatgaactctggaaaactggcaggtaccggaattatccaccagagcagcttgtggacataattgcaagggttttagctttggtaccaccctggacccgagtctatcgtgttcagagggacattccaatgccgctcgtaacatctggtgttgaaaagggcaatcttcgggagctggctttggcacgtatggatgacttgggacttaaatgtcgtgatgttagaacccgtgaggctggtattcaggatattcatcataaaataagaccggaagtagtggagcttgtacgacgtgactattgtgctaatgaaggttgggagacattcctttcatatgaagatacacggcaggacattttagttggtttattgcgtttgcgcaaatgtggccacaacacaacatgtccagagctcaagggtaggtgttcaattgttcgtgagcttcatgtttatggaactgccgtgcctgttcatggccgtgatgcagacaaattgcaacaccagggttatgggacgcttcttatggaacaagcagagaggattgcttggaaggaacataggtcaatcaaaatagctgtcatatcaggtgtaggaacacgccattattatcgaaagcttgggtatgagcttgaagggccgtacatgatgaagtatttgaactagttgtacatagtaagagtgaaatcttgtttcatatcattggatatcgtcccttcttgggtgcaatatgcattattttctggtgcatccttaacacagcttggttacatggtgaattacagtatttgaaggagtcaagaatgttctacctgttcctgattacaagatttagatgctttatggaaagcagtatcatttagatgtaaaaggattgaggccaattataccttgtaacataacatgttatttttgacatttattcctaatagattaattttcctgcatttaatatatatatatatataattttatgagatttttcactttcttcaaaaaaaaaa

SEQ ID NO: 149 - DNA, 1941 bp, Pinus radiata
ctctcctgaaagcaaacatcttgaaagcaaacatctcggaagaagccaagctcaattggatgtacacagatgctcggattcagggatttatatacatctatatgcgagcatctgcagagagcctcgggcagactcccaattattgcagcggccactagtttgatcagcacccctgaaatagcagcagtagaaaaagaaaacaaggcgccaaattctgttgacaagatgggcatgggctctgcggacgaaagtgggaggttcagtacaagcaatggccaatttatgaatatgaacaatggggttgtcaaggaggagtggaaaggcggggttccagttgtcccgtcagcgcccacgacagtccctgtaatcacaaacgttaaactcgaaaccccatcgtcgcccgatcatgacatggcgaggaagaggaaattagggttccttccgctggaggtcggtactcgggtgctctgcaaatggcgagacggcaaattccaccctgtcaaaatcatcgagcgtcgcaagctgcccaacggagccaccaacgactacgagtattatgtccattacactgaattcaatagacgacttgatgaatgggtgaagcttgaacaacttgaactggactctgtggagactgatgcggatgagaaggttgatgacaaggcaggaagcttgaaaatgacccgccatcaaaaaagaaagatagatgaaactcatgtggagggtaatgaagagcttgatgccgcgagtcttcgtgagcacgaagaatttacaaaagtgaagaacattacaaaaatagagcttggaagatatgagattgagacatggtacttttcaccatttccatctgaatacaataattgcgagaagctgtatttctgtgaattttgcctcaattttatgaagcggaaggagcaacttcaacgacatatgaggaagtgtgatcttaaacatccacctggagatgagatttatcgaagtggaacactttctatgtttgaggtcgatggaaagaagaacaaagtgtatgcacagaatctctgctatttggccaagttgttcttagaccacaagacactttactacgatgtggatttgttcctattttatattctttgtgaatgtgatgagcggggatgtcacatggttggatatttttcaaaggagaagcattccgaggagtcatataatttggcatgtatacttacacttcctccatatcaacggaaaggatatggaaagttcctaatttccttttcatatgagttatccaagaaggaaggaaaagttgggaccccagagcgccccttgtctgatcttggattattaagctacagaggttactggacaagggtcctgctggacattttgaaaaaacacaagagcaatatttccatcaaggaacttagtgatatgacagctatcaaggcagacgatgtgctcagcactttacaaggcttagatcttattcagtatcggaaaggacagcatgctatctgtgcagatcctaaggttttggatcgacacttaaaagctgtagggcgaggtggtttggaagttgatgtttgtaaacttatttggaccccctacaaggaacaatgatgaaatatctgttttttttcttgttttttttttcctgttcaatatgcccctttctaaatgaagggcactgtaatattatcgattattccttgttttgtacccctagaatctgggtaggtgatcagtaaacgttgtacatagatggtggcgacgttttttatttgaaattttagattttttgaaagaagcaactggaatttatcgagaataggaatcatccagatttaatgccacttaggtgatcggtgacccacttgtacatatagatgttggcgatgtttttttcctggaagatgcagctggaattataaaggacgggattcatccacaaaaaaaaaa

SEQ ID NO: 150 - DNA, 1911 bp, Pinus radiata
atttatgtgtgcacgctaagttccaacgatacagtcctttgaagcacgtggaaagaaactcggcctctgcagtggacataaacccaaaccctagtgagttttagggtttcatgtagagaaggtttgaaatctgttggcgatgggatccttggatgaatccacttgcagcgaagagatcagagatgaaggcaaggattcaattaggactaaatttaaagtcgagtccactgtaaataatgcacaaaacggaggcaatgacaattcaaagaagaaaagagcggccggccttccccttgaagttggcattcgtctcctctgcaagtggagggattcgaaactgcaccctgttaaaatcattgagcgtcgtaagcttcctaatgggtttcctcaagattacgagtattacgttcactacactgaattcaatagaaggcttgatgagtgggtgaaacttgagcaatttgaacttgattctgtggagactgatgctgatgagaaaattgaggacaagggaggaagcttgaaaatgactcgccaccagaaacgcaaaattgatgaaatccacgttgaagagggtcagggtcatgaggattttgatcctgctagccttcgagagcatgaggagtttacgaaagttaagaacatagcaaaggtagagcttgggaggtatgagattgagacgtggtacttttcacctttccctcctgaatacagccattgtgagaagttattcttttgcgaattttgtctcaatttcatgaagaggaaagaacagcttcaaagacatatgaggaagtgtgatctgaagcatccacctggagatgaaatatatcgcaatggaaccctctccatgtttgaggttgatggaaagaagaacaagatatatgggcagaacctctgctatctggcaaagttattcctcgatcacaagacactttattatgatgttgatttgttccttttttacgttctttgtgaatgcgatgatcgtggatgccatgttgtgggatacttttcaaaggagaagcattctgatgaagcatataatttggcctgcattcttactcttcccccatatcagagaaaaggatatggaaagttcctcatagctttttcatatgaattgtccaaaaaagaagggaaggttgggaccccagagcgccctctgtctgatcttgggttattaagttacagaggatactggacaaggatccttcttgacattcttaagaaacaaaggggtaacatttcaatcaaggaacttagtgacatgacagctatcaaggtagaagatgttatcagtacactgcaagtgttggatcttattcagtatcggaaaggacagcatgttatatgtgccgatccgaaggttttagatcgtcacctgaaagccgctggaatagctgggctggaagttgatgtatctaagcttatctggactccctacaaagagcaatgtggatgattaattttttagacatgtttcttcatggttatgctgagcgaaatgagaaaatctagcaattccattcttttttgcatcctttggaaaggtagctagagaaaattgctcctggtgaagaggcagttgtatatttgtttccatggtggttttgatattctttttcaaatctgagaacatctcttactcattattgcgaaagtttaaggtttcatcatgcatccctgcgtgcaacaagttgtgataatttaaggctgaatgaacagcattccagcacacaagtgtcacttaaagaaattcatcaattctttgaaattattgttcccttttgatgcggcccctttctggaggggcaatcaatgtctgcgttgccactcttttgatgaggattgtaaaggaacggtaccattgccaataaagtaatgaaaattttctaacgaaaaaaaaaa

SEQ ID NO: 151 - DNA, 3235 bp, Pinus radiata
acgactccccgttcttcgtcagatttacttcatggtttttctcaaatccatccgaagcagtagctgcttatcagtctgcaacaaaccctaagagagagaaaatcgttattggttctcatggccttagtggaccttgcaatttactgcaaacgtatttccgggtttgttctgcatcgattattgagggataccatctgcgggtttaatttattttagtcagggatttagctggtttgttttaagctggggtttctagtttagtagggttattaatggatccggtgtgagatatttgtttacttttaagggctgttacgatggtttaggagccgagctactgcttgaactatggcttaggtgttgtggaaaatgatatacatcatatttcgtcagttttttaagaaagaagtgaagaaccaagtattttgaagttgtcatattatataatacactctataacaagttaaaatccattggatttggcgtgagctcctctggcagtggaaattgatgtcatctttaatgacagttgttttagtaatgaagctgttagggtgtttataggttttggagtcaaggaactggggtactcagttggtatcgtgcttttcgttgaagattttgtgtatggcatctgcacctatggttgggtgtgatgattctcgagacaaacatcgttgggtagagagcaaagtttacatgagaaagggtcatggcaaaggatctaaaggaaatgctggttttaatgctcaaaattcgacagcacaagtgcggagagagaatgataacatgggcaattcgattgctgataatggaaaatctgaagcagcatcggagggactgtcgagccttagcaggaagcaaataactgtaaatcaggatcatcctccgaatgagactagtagcatgcctgctgttggaggattgcagaatatagatactcatgttacttttaagttggaggggtgctccaagcaggagatatgggaacttcgcaagaaattgactaacgaattagaacaggttaggggcacattcaagaaacttgaagctagagaattgcagttgaggggatattctgtttcggcaggagtaaacactagttacagtgcctctcagttctctggaaatgacatgaggaacaatggcggcaaggaggtcacatctgaagtggcatctggtggagcgatcacgcctaagcaggctcaacgagagtctaatccccctcgtcagttgagcatttctctcatggaaaacaatcaagctgcaagcgacatgggggaaaaggggaagcgcacaccaaaggccaaccagtattaccgcaattcggagtttgttttgggaaaagataaattcccacctgcagagagtaagaaatctaaatctactggtaacaaaaagatttcacaatccaaagtattttctaaagaaacaatgcaggtaggaaaagagttcatgccgcagaagtctgtgaatgaggtcttcaaacagtgcagcttgttgcttacaaagctgatgaaacacaagtatggttgggtgtttaacttaccagttgatgcacaggcgctgggacttcatgattatcataccataataaaaaggccaatggaccttggtactgtaaagtccaagctggagaaaaacctatacaactcacctgcatcatttgccgaagatgtgaaactgacattttctaatgccatgacgtataacccaaaagggcatgaagttcatacaatggctgagcagttgctgcaattatttgaggagcgctggaagactatatatgaagaacaccttgatggtaagatgaggtttggaagtgggcagggacttggggcaagcagcagtactaagaaactgcctttccaagactcgaagaagaatataaagaaatcagaacctgctggagggccatctcccccaaaacccaaatccacaaatcaccatgccagtagaaccccaagtgccaaaaaacctaaggccaaagatccccataaacgtgacatgacttatgaagaaaagcagaagctaagtacaaaccttcaaaatttacctcaagagagattggaacttatagttcagatcataaagaagaggaacccatctctatgccagcatgatgaagagatagaggtcgacattgacagtttcgacactgagactctttgggaacttgatagatttgtcaccaactacaagaaaagcttgagcaagaataagaaaaaagcgttgcttgctgatcaggctaaaagagccagtgaacatggttcagccagaaataagcatccgatgattggaagagagctaccaatgaacaataaaaagggagaacaaggtgagaaggtggttgaaatagatcacatgccaccagtaaacccgcccgttgttgaggtcgagaaggatggtgtttatgcaaaaagatcgagcagctctagtagctccagtagtgattctgggtcttcttccagtgactctgattctgggagttcctcaggaagtgaatccgatgcctatgctgcaacttcacctcctgctggttcgaacacatcagctaggggttgattctgagaatactgtggcagaaggtgaagatggtttatcttatttggagtcaaatgcagatgtttggttttcattcgatggaacccaattgcttcagaggcgacaatgtaggaatgcaatgcatgtattctgtttattcaccattgactgtggcattgttataaccaaaaagagagtagtatatttttaatgcaaccacattcctctggtaagctgctttctcgatggtcatattataggatatgatcagaaatcccatctgtatattttgaaaggacattggtaagagtgtaagagagaccactattgatgctactataaaaagggattatctttaggcagttgcactctgcaggtatgttcttaccatcgtagccacaggataggaactactgacttagtgcaaaagacatgatagacagtaaaagagcagctaagctcatacaatcctatcgtgtccttttttattgtggctgtattgaagaaagtagattttagcccattgttctgtactttgaattattgattcaaagggtgtatcataggacttgctgtgacaagttttgacagcccgtcttataaactgtttagatgtaaagtatattttagccgctgttgttgtaaatttatgtttttcattgctatcaacatttagttttcaaaaaaaaaa

SEQ ID NO: 152 - DNA, 2305 bp, Pinus radiata
gctgcgattgaaatttaatcagaagtgaaattgaaatttaatcagaacccaaagatggagggccactcgggagctctgggatttgggcaaggcttctccaggagctctcagtctccaaacctttcgccctcaccctcgcactccgcctcggcatcagtgacgagctcgggccaaaagcgcaaacgcaatgaagttgagcacgcaggggtcgcttctaattccacgggaatgttcgcagtgcccccttcccacatatactcccacttgcatcccatgtcgatgtcgatgcccatgccaatgcacaattcgcacccctcctccctctctgagagtcgagacggtgccctcacctccaatgacgacgatgacaacctcaccgggggcaaccagtcgcagctggacagcatgagcgcaggcaacaccgacggcagagaggatttcgacgacgaagatgacgatgatgacgatgaagaagatgacgatgaagtagaaggagacgaagaggatcaagatcatgaccctgacgccgatgacgactcggacgatggccacgattccatgcgtaccttcaccgctgctcgcctggacaatggcgctcctaattcccgcaatttaaaacccaaggctgatgctgctggagttgcaattgctcccactgttaaaactgagccaattctcgacacagtcaaggaagaaaaagttagcggtaacaacaacaacaacagtgtctccgctaacaatgcccaagttgccccttctggttccgctgttttactcagtgctgtgaaagaggaggctaataagcctacttctaccgatcacatccagaccagcggagcctattgtgctagagaagaatccctcaagagagaggaagacgcagatcggcttaaattcgtgtgtttcggtaatgatggaattgatcaacacatgatctggcttattggattaaagaatatatttgcaaggcaacttccaaacatgccaaaagagtatattgttagacttgtaatggacaggagccacaagtcagtgatgatcatcaagcaaaatcaagttgttgggggcatcacttatcgcccttatcttagtcagaaatttggagaaatagctttctgtgctattacagcggatgaacaagtaaaaggctatgggactaggctgatgaatcatttgaaacaacatgcccgtgatgtggatgggctaacacactttctaacatatgctgacaataatgcagttggctacttcattaaacaggattttacaaaggagatcaagctggagaaggagagatggcatgggtacatcaaggattacgatgggggaatcctcatggagtgcaaaatagaccctaagttgccttacacagatctaccagctatgatccgctggcagcggcagacaatagatgaaaagataagggagctctccaactgccatattgtttactcaggcattgacattcagaagaaagaagcaggcattcctaggaagcccatcaaggttgaggacattcctggtctaaaggaggcaggctggacaacagatcagtggggtcactcgcgttttcgtctactgaattccccatccgagggcctgccaaatcgccaggtcctccatgcctttatgcggtctctacataaggctatggtcgaacatgctgatgcttggccattcaaggagccagtagatcctcgtgatgtgcctgattactatgatatcataaaagatccaatggatgtgaagaggatgtttacaaatgcacggacatataatacccatgaaactatttattataaatgtgcaaacaggtgattatctcacaggttggattcctacttttttaacaaacttcaagctggaactcaggttaataacaagagtcagcagtgatggaattgtcatcataatttcctttattcaaatcaaacaagcactggctgtgcccgcatggtgctgtgctttatgcttttgcatggttttcctataagatgtatgaattcgcactgtggtgcaattttatgaattaaactcaaatggaaaggttgccggcttttaactatagctcttgtagatttcctcagttggcatggaagcaattggtgttgccacagaagaagttggattttccttatatttttttacaaaagctgttgtgtttataattctgcttgttagtgtgaataatgttaatagtttgatcttccttgaatttgtggggatactgatatttcttttttgggaaagctatgtgctataacaataaatgcaccaattggtttttggtttgtcaaaaaaaaaa

SEQ ID NO: 153 - DNA, 2083 bp, Pinus radiata
gatcgctcgagagttcctctctcagctgttttccaattctggactaaacaagggtgcaggcggcagccagttgaaacagtggcagagtgggggtgaacatgcaacttagtgggagcatggacccgctgtgcaaacacacgcatagctggaagtgctattaacgagtaaatactacgaagccattcggtctctggattcatccgactaattttggggtgcaaccatttgccaggggccctcgattagacggagggtggaatggaagaatcgggcaattcactgacctctggtccggatggaagtaagcgaagagtatcttatttttatgattcagacatcgggaactactactacagtcagggccacccgatgaagccacatcgaatcagaatggctcacagtctgatagttcactatgccctggatgagaagatggaggtttgtagacctaatcttctacagagcagagagcttagagtatttcatgcagatgattacatatcttttcttcagtcggtcactcctgaaactcaacacgaacagctacgacaattgaagagatttaacgtgggggaggattgccctgtttttgatgggctatacaatttctgtcagacctatgcagggggctctgtgggagcagctatcaaacttaataacaaggaagcagatattgccattaattggtctggtggtctccaccatgctaagaagtgcgaggcatctgggttttgctatgtaaatgacattgtcttggctattcttgaacttctcaaggtccatcaacgagtgctttatattgatattgatattcatcacggggatggtgtggaggaggccttctacagtactgaccgagtcatgtctgtgtcatttcacaagtttggagactacttcccaggcacaggccaccttaaagatgtaggatacgggaaagggaagtattattcattaaatgttcctttgaatgatggaattgatgacgagagctacaagaatctctttagacctataatccagaaggtaatggaaatatatcagccggaagctgttgtcttgcaatgcggagcagattctctgtcaggcgataggctaggttgttttaatttatcagtcaaaggacatgcagactgtgttcgatttcttcggtcatttaatgttccattggtgcttgttggaggcggtggttacactattcgcaatgttgcccgctgttggtgttatgagactgcagttgctgtaggcgtcgaaccccaagataaattgccttacaatgagtactatgaatattttgggccagattatactctccatgtggctcctagcaacatggagaatcagaattcagccaaggaattagcaaaaataagaaacacattgctggaacaattgaaacgaatacaacatgttcccagtgtgccattccaagaaaggccaccagacaccaagtttcctgaagaggatgaagaggattatgaaaagcgacctaaaggtcataaatggggtggagaatactttggttcggaatccgatgaagaacaaaaacctcagaatcgtgatatagatatttcggacaaacctggcataagaaggcagtcacctcctaatgttgaagcggccaaaaaaataaaagtagaagaagaagatggagacattggaatagttaatgagaacgatggtgcaaagtggccattgggtgaagctggataaaaagtatattatggaggaaataagcaggagtttcagatcatttgcacaattccaagaagattatttttctccggaagccaaagagctaccgggaatgggaatttcaaatggtcatttctatttctctaatttccagtcagatggaattgtacttctatcttcatagacttcaaggctattgtgtacataaagaaagcagataataataaaattttgtcggttttattgaatgaaattccccataatgttttactattccgtctgggcttagagatgtacgttaattggtcatttaagacgactcagttacatagaaatccacaagtggcatagtacaaacataaatataaagctttttttaccaaaaaaaaaa

SEQ ID NO: 154 - DNA, 2049 bp, Pinus radiata
ctcgagagttcctctctcagctgttttccaattctggactaaacaagggtgcaggcggcagccagttgaaacagtggcagagtgggggtgaacatgcaacttagtgggagcatggacccgctgtgcaaacacacgcatagctggaagtgctattaacgagtaaatactacgaagccattcggtctctggattcatccgactaattttggggtgcaaccatttgccaggggccctcgattagacggtaaatagttgctgagatttttactcgaatctgccagtattcaaatctagtcaatatccgtgttgagctaaacaagcgctgaaagtttgctcgaatcagcaagagggtggaatggaagaatcgggcaattcactgacctctggtccggatggaagtaagcgaagagtatcttatttttatgattcagacatcgggaactactactacagtcagggccacccgatgaagccacatcgaatcagaatggctcacagtctgatagttcactatgccctggatgagaagatggaggtttgtagacctaatcttctacagagcagagagcttagagtatttcatgcagatgattacatatcttttcttcagtcggtcactcctgaaactcaacacgaacagctacgacaattgaagagatttaacgtgggggaggattgccctgtttttgatgggctatacaatttctgtcagacctatgcagggggctctgtgggagcagctatcaaacttaataacaaggaagcagatattgccattaattggtctggtggtctccaccatgctaagaagtgcgaggcatctgggttttgctatgtaaatgacattgtcttggctattcttgaacttctcaaggtccatcaacgagtgctttatattgatattgatattcatcacggggatggtgtggaggaggccttctacagtactgaccgagtcatgtctgtgtcatttcacaagtttggagactacttcccaggcacaggccaccttaaagatgtaggatacgggaaagggaagtattattcattaaatgttcctttgaatgatggaattgatgacgagagctacaagaatctctttagacctataatccagaaggtaatggaaatatatcagccggaagctgttgtcttgcaatgcggagcagattctctgtcaggcgataggctaggttgttttaatttatcagtcaaaggacatgcagactgtgttcgatttcttcggtcatttaatgttccattggtgcttgttggaggcggtggttacactattcgcaatgttgcccgctgttggtgttatgagactgcagttgctgtaggcgtcgaaccccaagataaattgccttacaatgagtactatgaatattttgggccagattatactctccatgtggctcctagcaacatggagaatcagaattcagccaaggaattagcaaaaataagaaacacattgctggaacaattgaaacgaatacaacatgttcccagtgtgccattccaagaaaggccaccagacaccaagtttcctgaagaggatgaagaggattatgaaaagcgacctaaaggtcataaatggggtggagaatactttggttcggaatccgatgaagaacaaaaacctcagaatcgtgatatagatatttcggacaaacctggcataagaaggcagtcacctcctaatgttgaagcggccaaaaaaataaaagtagaagaagaagatggagacattggaatagttaatgagaacgatggtgcaaagtggccattgggtgaagctggataaaaagtatattatggaggaaataagcaggagtttcagatcatttgcacaattccaagaagattatttttctccggaagccaaagagctaccgggaatgggaatttcaaatggtcatttctatttctctaatttccagtcagatggaattgtacttctatcttcatagacttcaaggctattgtgtacataaagaaagcagataataataaaattttgtcggttttattgaatgaaaaaaaaaa

SEQ ID NO: 155 - DNA, 1633 bp, Pinus radiata
ggggaaaacaaaggcagcataaaccctaaacccgaaattccctctagcctctgaacctaaaccctaaatgtcttctcgactttgaagcctatagagttctccaaaagctcagtttatctatttagttcatatttttcgttgtgtggttttacggtttgcggccaacgttattgttctctttcgtggagcgtaatcgatctgcaatcttcgggcgtcgttcgtgctctctaagggaggaagaagatatttcattcatcgtcatggagttttggggcgttgaagtgaagcctggagaggctttgacatgtgatcctggggatgaaagataccttcatatgtcccaggctgccattggggacaaagaaggtgctaaggaaaatgaaagggtctccttgtatgtccacgtggatggtaaaaagtttgtgcttgggaccctgtcccgtggaaaatgtgaccagattggactggatttagtgtttgagaaagagttcaagctctctcatacatctcaaactgggagcgtattcgtatctggctacactacagtagatcatgaagccctggatggatttccggatgatgaagacctagagtcatcggaagatgaggaagaagaattagctcagataacgactttaactgcaaaggagaatggtggcaaaaccggagccaagcctgtgaagcctgaatctaagtcatctgtaactgataaagcagcagctaaagggaagccagaggtgaagccaccagtcaaaaagcaagaagatgattctgattctgatgaagatgaagatgaggatgaagatgaagatgaagacgatgatgatgaagatgatgaggatatgaaagatgcgagtgcaagtgatgatggggatgaggaagatgactccgatgaagaaagtgatgatgatgaggaggaagatgaggaaaccccaaagccggctgctgggaagaagcgacctatgccagcctcagacaacaagtcaccagcaacagataagaaggcaaagatcaccacaccagctggaggtcaaaagccaggtgctgacaaaggcaagaaaacagaacacattgcaactccttatccaaaacacggtgcaaagggccctgcttcaggtgttaagggcaaagaaactccacttgggtcaaaacaaacacctggttcaaaagtgaaaaattcgtctacacctgagtctggcaagaaatctggccagtttaaatgccagagttgttcaagggactttgcaacagaaggagcattgagcagccacaatgctgcgaagcatggtggaaagtgaagtatttcgtttttacattttcacaactgtttttgcactctcagtgcatcgttgccagaaaattcctaaactaaggtcaactgtgtatcagatctctagtcagtgtttagagatttacagaaagttgtgtactaatttgtattgtaacgtccatttatccaacgagtcctccattcatgctatttttgtgagttgcttctaagggaggatttctcaaggtagcacaattttgtattagaggttaaatctagtagatgtctgttatgtgcggcattgttgaattgaatgattttattttttcaaatttgtcggaggctactgatttaaaaaaaaaa

SEQ ID NO: 156 - DNA, 2495 bp, Pinus radiata
attgatttaagtggggttcaagaaaatcgtatccccaatccgcatcttgggtgcttacatcaatctgtttatatcaaccaatcctcgcaacaaattggggaagaaaggccgttcaaatgtggcatggtatattctctgtgtataatcttcgtgtctggattttttccggcccaagcagcccaagcagaccatgtaggcttgttgttaaaccatgattaattgacttcatgggtgttttccagtctgaaatttggtggaggactagaaccagtttttaatagtttgttttggcagatgaactttatccttctgaaagtttttgagaacaaaaggaattagcggttgtttatgaagaagaggctccatgatggagactggtggcaattctcttccatccggaccggatggagtgaagaggaaagtggcatatttttatgacccagaggtggggaattattactatggacaagggcatccgatgaagcctcaccgcataagaatgactcatgccctccttgttcagtatggtttgcataaagaaatgcagattcttaagccctaccctgcgagagatagagatctctgccgtttccatgcagatgactatgtagcatttttacgaggaataactccggagacaatacaggatcaagttaaggcgttgaaacggtttaatgttggggatgattgcccggtttttgatggcttgtaccaatactgtcaaacttatgctggggggtctgtcggaggtgctgtgaaactcaatcataaactctgtgacattgcaattaattgggctgggggtcttcatcatgctaaaaaatgtgaggcatccggattttgctatgtgaatgacattgtgctggccattctggagctcttgaaatatcataagcgtgttttgtatgttgatattgacattcaccatggtgatggagttgaggaggctttctacacaacggatagggttatgacagtatcatttcacaaatttggggactatttcccagggacaggtgacattagagacatcgggtgcgggaaagggaaatattatgctgtaaatgtccctttagatgatggaattgatgatgaaagttttcagtctctgtttaaacctattattcaacaagtgatgttggtttacaatcctgaggcaattgttctccagtgtggagctgattctttgtctggagacaggctaggttgctttaacctttctgtgaaagggcatgcagagtgtgttcgatacatgaggtcattcaatgtgccacttctgatggtcggtggtggtgggtacacagttcgtaatgttgctcgttgttggtgctatgagacaggggttgctgttggtgtggagattgatgacaaaatgcctcaacatgaatactacgaatattttggaccagattacactgttcatgtggctccaagtaatatggaaaataagaacacgaagcagtatctggataaaattaggtccaaaatacttgaaaacattaattcattgccatgtgcgccaagtgctcaattccaagtgcagcctccagatactgatttccctgaactggaagaagaggattatgatgaacgtactagaagtcataaatgggatggagcaagttgtgattctgattcagagaatggtgatttaaagcatcgtaatcatgatgttgaggaaagtgcattcccacggcataatctggccaatattagttacaataccaagattaagctagaaggtgttggtacaggtggtcttgacatggctgctggaacagacacaaaaaagaatgacgagtcctttgaagccatggactatgaaagtggagaagagttacgacaggatcattttgcttctacaataaatgcttctcaaccatgtgatcctgctcttttgacaggagttcaaaatcagttgcagtcaacagatactgtaaagcccatagaacaaagtggcaatgctccaggaataccaccaccttcagtggcaactgtaagcacgggcactcgcccgagttcaattagccggacatcatctttgaattcaatgtcttcagtaaagcagggttccattttgggaccaaatcctcctcaagggctgaatgcatctggtctacaatttccagttccaacttctaattcacctataaggcaaggtgggtcttattctataactgtacaggccccagacaagcaaggtttgcaaaatcatatgaagggacctcaaaatatgccagggaattcttgaaaattatatatccttctgcaatttgaaacacaggttactttgtataatgataatgtaatgtcatccccttggtcgcaatgtgcttgagatcagtttagaagctaattatacacttagaatgctaattggtgaggtgctaaaacttctctgtattttattctacagtactgtattcgaagatcctgaaaatttactaaaacaaatggaatatcaacaacctaggatcattatagcaaaaaaaaaa

SEQ ID NO: 157 - DNA, 1824 bp, Pinus radiata
aattaccatacaccacagcataatcaactgggcggcttaattctggaacgcgaaacgaccgcaggccgaatcgaatttcatacagtacatggaagaggaagccacgaaagccgggaagcaacgcgtagggtaggtgtcgtttttgcccgttggaaatgcctccgaaagatagagtcgcctacttctacgacggggatgtgggaagtgtctactttggcccaaatcatcctatgaagccacatcgactgtgcatgacacaccatctggttctttcttatgaacttcacaagaagatggagatctatcgaccacacaaggcatatccagtggaacttgctcagtttcattcagcagactatgtggagttcttgcatcgaataacgcctgatacacagcacttgttcaccaaggagctagtaaaatataatatgggagaagattgtcctgtatttgagaacctctttgagttttgtcaaatttatgctggtggcactatagatgctgctcatcgactgaacaatcagatttgtgatattgcaatcaattggtctggtggtcttcaccatgctaaaaagtgtgaggcatcaggtttctgttatattaatgacttggtgctgggaattttggagttgcttaaacatcatgccagagttctctatgttgatattgatgtccaccatggtgatggagttgaagaagccttttattttactgacagggtgatgacagtgagctttcacaagtacggtgacatgttttttcctggaacaggtgatgttaaggaggttggagaaagagaaggaaaatattatgctattaatgttcctctcaaagatggaattgatgatgctagtttcacgcgacttttcaaaactattattaccaaggtagttgacatataccagcctggtgccattgttcttcagtgtggagctgattcacttgctggggatcgccttggttgctttaacctatccatcgatggtcatgcacagtgtgtgagaattgtgaagaaatttaatctgccactattggttactgggggaggaggctacacaaaagaaaatgttgctcgttgttggtccgtggaaactggagtacttcttgatacagaacttcctaatgaaattcctgataatgattacatcaagtacttcgcacctgactattccttaaagatcaacactgctgggaacatggagaatctgaatagcaagacatacttgagcgcaattaaagtgcaggttatggagaatctgagggccattcaacatgcaccaagtgtacagatgcatgaagtgcctcctgacttttatattcctgatattgatgaagatgaacttaatccggatgaacgtatggatcagcatactcaagacagacagatccagcgagatgatgaatattatgatggagacaatgacattgatcatgacatggaagaggcaagctgatagccgagaaagatatttgcccctttgatgcaatattaatgataacgctttgttggatgtcttttctttctacaatgacaataaattagtttttgtaatttataaagtattctcgagtgtactttcagaaattttgaggagcccttttccgccagaaatgatttatgttgcttttctgtaatagttcttccctccagggattctggctgtgtttctcccccagttttctgaaaatcttggtgataacaccagaagtagaaaactttgctctatataatttgtgctcgtgtgtgtacttgaagatccatcctcacatagtccaatgaagttttgcagtatcatatgcccaattttttttggaaaaaaaaaa

SEQ ID NO: 158 - DNA, 1568 bp, Pinus radiata
gctcccttacatcgctggtccgatcgttgatagtcaccccacctagagcctcccgggttgttgcatgaactgagatgcctaacaatcgaaaatcgaaccccaccatttcaagatcaagactcccacattcgcacccagcataaaacgtctcccatccccaacagatctcgttacctcagaacaaattaacgccacaatcgccatggattcttccaagtcagaagaagcaaacattttgcatgtgttttggcacgaaggaatgctcaatcatgatttaggcacaggggtatttgacacattggaggatccaggcttcctggaggtgctggaaaaacatcctgagaatgcagatagagtgagaaacatgctctcaattctcagaaagggacccattgctccctacaccgaatggcacactggcagggctgcatatctctcagaactgtactcctttcacagaccagattatgtagacatgcttgccaaaactagtacagcaggtggaaagaccttatgccatggcacacgcctgaatcctggttcttgggaagctgcacttcttgctgctgggacaacacttgaagctatgcgctatattttggatggacatggaaagctatcttatgcattagtgcgaccaccaggccaccatgcacagccaactcaagctgacgggtactgctttttgaataatgctggtcttgcagttgaactagctgtggcatctggctgcaagcgagttgctgtggttgacatcgatgtgcattatgggaatggaactgcagagggattctatgaacgagatgatgtgctcacaatctctctccacatgaatcatggttcttggggaccttcacatcctcaaactggatttcatgatgaagttggtcgaggaaaaggtctggggtttaatctaaatgttcctttgcctaatgggacaggagataagggatatgagcatgccatgcatgaattggtggtaccagccattagcaaatttatgcctgaaatgatagtcttggttattggtcaagactccagtgcatttgatcctaatggaagggagtgcttgacaatggaaggttatagaaaaattggtcaaataatgcgtcaacaagctgatcaatttagtggcggccgccttgtggtggtacaggaaggtggctatcatattacttatgcagcatattgtcttcatgccactcttgaaggtgtcctatgtctgccacatccacttttgtcagatccaattgcttattatccagagcatgatatttatagtgaaagagtaacatttataaaaaattactggcaaggaatcatctcgaccacagataaacgtaactgattagtttacgatatgtggttgtgactctgagtatttgaagctgttttacagctgtatatggataaatgttattagtgtgttgcaacaatacgctttaccttgtgtgtatagttttataacactctatggtatcactaccactatgggcctgtttagtccaagtttcctttttaatatttgccggtataaagtatatgattttcttagtgtaaaaaaaaaa

SEQ ID NO: 159 - DNA, 2097 bp, Pinus radiata
gaaacactgatatatatacctaaatcccaggtttaaataaaagctacatgtgttcgtcgcatccttctcttctctgattggggatttctctggattttgctatacagtcagatagcaacgaaacatagcagaggcacgtaagctttggtttaacctgtaggcattcgttctactgtgtatttatctagtccataggaacgagacatcggagattagaggtgagaggccatggaggagtctggcaatgctctggtatcagggcctgatgggagtaagagaagagttacatacttctacgatgcagacattggtaattattactatgggcaaggccacccaatgaagccacaccgcatgagaatggcccataacttgattgtccactatggcctccaccagaggatggaagtttgcaggcctcatctagcacagagcaaggacatccgtgcctttcatactgatgattacatacatttcttgagtagtgtagcaccagacactcagcaggagcagctgaggcagttgaagaggttcaatgtgggggaggactgtcctgtgtttgatgggcttttcaatttttgccagtcttctgcaggaggctcaattggggcagcccttaaactcaataggaaggatgcagacattgccatcaactgggcggggggcctccaccatgccaagaagtgcgaggcttcgggtttctgctatgtcaatgatattgtgcttggcatcctggaattgctaaaggtccatcagcgtgtactttatattgatattgatattcatcatggtgatggagttgaagaagccttctacactacagaccgtgtgatgactgtatcttttcacaaatttggggattactttccaggcacaggtcatattaaagatgtaggatatgggaaagggaagtactatgctttgaatgttcctttgaatgatggaattgacgatgagagctacaagcaccttttcaggcccattatccagaaggtaatggaagtctatcagccagaagcagttgttctacaatgtggagcagactcactctcaggggacaggttagggtgcttcaatttgtcagtcaagggacacgcagattgtgttcgttttgttcggtcatttaatataccacttatgctggttggtggtggtggttatactattcgtaatgtggctcgctgctggtgctacgagactgctgttgctgtaggtgttgaaccccaagataaattgccttataacgagtattacgaatattttgggccagactacaccctctatgtagcccctagcaatatggagaacctgaacacagaaaaagatttggagaaaatgagaaacgtgttgctagaacaattgagtaaaatacaacatacaccaagtgtaccctttcaggaaaggccccctgatacagaatttaatgatgaggaggaagaggacatggaaaaacgctcaaaatgccgtatctgggatggggagtacgttggttcagaacctgaggaagatggaaagcttccaagatttgatgcagatacttatgagagatctgttctcaagcatgaaaacaaaaggttagtgcctgtttcaaatgttgaacctctgaagagaataaaacaagaggaagatggagcagctgtttaagtactagatgatcttaattgcactgccatttccttcagatggtcacttctctcatgttcattcaatcattttaattttcattctaatatggttcatgccctagatgaagaaagaaggcctgtgaacttcttttaattttgatcctggctttaaggctcattttagagaaggaactttcatgcactacatggcttaaagatattgattttgtgctgtgaaagcagaacgaaaatgaaaatggcactgccacccggacatttgtccaatctgcatgagcacactgagggaaaagctgaagcagaatcagctttgaccagtatttagtgtcttgtatacaattcttgtttcagtgaatgctgctcccccttctcgattaccaacctgtacttaaacattgttgctatcagaagagtattatttttcaatgaatgcaagataaatgtaaaaaaaaaa

SEQ ID NO: 160 - DNA, 1824 bp, Pinus radiata; identical to SEQ ID NO: 157

SEQ ID NO: 161 - DNA, 2512 bp, Pinus radiata
ggagaggttctgtctgagagaagaagatggatttgaacttggtgagccatggagaagaagaagaaggggtaaggcgtcggaaagtaggaattgtatacgacgaacgaatgtgcaagcatgctactcctgaggatcaaccacatcccgaacaaccagatcgcattagggtgatatgggacaagctcaactccgccggggtcctccataaatgtgttatggtggaggcgaaagaagcatcggaggagcaattggcgggggtccatagtcggaaacacattgaggtaatgaaaagcattggcactgctagatataataagaagaagcgggacaagttggcagcgtcttacagttccatttatttcagccaaggctcctcggaagccgcccttctcgctgccggatccgtggtagagatatctgaaaaagtagcttcaggggaattggatgccggagttgctattgttaggccaccaggtcatcatgcagaggctgacaaagccatggggttttgcttgttcaacaacatagctattgcagcaaaacacctcgtccatgaaaggccagagttaggtgtacaggaagtgttgattgttgactgggatgttcaccatggcaatgggacacagcacatgttttggactgatccacatgttttgtatttttctgttcatagatttgatgcaggaacattctatccaggaggagatgatgggttctatgacaaaattggagaagggaaaggagcgggatacaatataaatgttccttgggagcaaggaaaatgtggagatgcagattaccttgctgtttgggaccatgttttggttcctgttgcaaagagttatgatccagatatggttcttatttctggagggtttgatgcagcacttggtgacccattgggtggatgccgacttacaccttatgggtattcactaatgacaaagaagttaatggagtttgcaggtgggaagattgtcttggccttagagggtggctataatcttaagtcgttggcagattcattcctggcttgtgtagaagctttgcttaaagatggacctagtagaagctctgttttgactcatccatttggatcaacatggcgtgtaatacaggcggtgcgcaaagaacttagctcattttggccagcattaaatgaagaactacaattgccaagactgctgaaggatgcctcagaatcatttgacaagctaagttccagttcaagtgatgaaagctctgcttctgaagatgaaaaaaaaattgctgaagtgacgtcaatcatggaagtctctcctgatccatccagcattcttgccctaactgctgaagacattgctcaaccactggctgggttgaaaattgaagaggctggtactgatagccagagatcatcagatcacactttgttagatttaactaatgatgacacccaaaagttgaaacagttcgagggggagatttttgtcatgattggtgatgaagaatcagttccatcagcctcaagtagcaaagatcagaatgagtccactgtagttttatcaaaaagtaatattaaagctcatagctggagattgactttctccagcatttatgtttggtatgcaagttatgggtcaaatatgtggaatccaaggtttctctgttatattgaaggggggcaggttgaaggcatggcaaagcgctgctgtggttcagaggataaaactcctcctcaaaggatacagtggaaagttgttcctcatcgaatgttttttgggagatcatacacaaatacatggggttcaggaggagtgtcctttcttgatccaaattgtagtgatacgagtgaagcgcatgtctgcttgtataaaataacgctggcacagttcaatgatttgctgcttcaagagaataatttgaattgtgggactgagcatccattagtggacttatcttccattgatgcaattagaaatgggaattctatacttgaacttatcaaggatagttggtatggcactctcatttaccttggcatggaaggaggccttccaattgtgactttcacgtgctccgtgtgtgacgttgaaaagttcaagcatggacaactaccgctttgtcctccatcttcaaggtacgaaaatattctcattcgaggtctcgtccaagggaaaaaactttctgaagatgatgcaacggcctacatccgtgcagcatcaacatcacccctgctgtaaataaaacatgaactgatcatttatattcatatctattatttctttcccttggcacgctaccagttctgccactctataatagcagcatagattcagtagaaccacacttacatgctcatgattaatcgattttaaagaatgcccaaggcaatcaattcatgtccgtgtccatatggggtcattctttctattcaggtgcatgcagtacattgagatgatgtgcaggatattcaaccgagtgcagtcattctttcaaacaacttgacaggtgtaaactcgtgccgaatcgg

SEQ ID NO: 162 - DNA, 2319 bp, Pinus radiata
tccagtcaatttataggcattggccgttgcagttcctgtactctctgttgtttctcttgaaggaaaatctatggcggacgaagatctggatctttccgatgtaggggaagtagaagatgaaccaggtgaggagatcgaatccactccacccctcgctgtagggcaggagaaggagataaacagcttggctttgaagaaaaaacttctgaaggttggcacaaggtgggaaacgccagaaaatggagacgaagtaacagtgcattacactggaactttaccagatggtaccaaattcgattcctcgagagacagaggagagccctttactttcaagcttggccaaggccaagttatcaaaggatgggaccaaggcattgttaccatgaagaaaggggaacgtgcactattcacaatacctccagaattggcctatggttcttctggcgtgcgacccactatacctcccaatgccaccctccaatttgatgtggaattactttcgtggactaatattgttgatgtatgcaatgatggaggcattctcaagcgaataatatctgaaggagaaaaatatgaaagacccaaagacccagacgaggtgactgtgaaatatgaagcaaagcttgaggatggaacactcgtggcaaaatccccagaagaaggcgtggagttttatgtcaatgatggacacttctgtccagctattgcgaaggcagtcaaaacaatgaagagaggagaaagtgtgattctcaccataaaacctacgtatgcctttggtgagcggggtaaggatgctgaagaggggtttgctgcgattcctccaaatgctactctcactacgagtttggaattagtttcatttaaagctgtgatagcagtaacggaagataagaaggttatcaagaaaatcctgaaggaagctgatgggtatgataaaccaagtgacgggacggtagtgcagatcaggtatactgctaagctgcaagatggtacaatctttgagaagaagggatatgaaggcgaggagcctttccaatttgtagttgatgaagaacaagtcattgctggtcttgataaggcagtggaaaccatgaagacaggggagattgccctgattacaataggagctgaatatggttttggaaattttgaaacccagagagatctggctgtaattcctccaaattcaactctcatctatgaggtggaaatgatatcatttaccaaggaaaaagaatcgtgggatatggatacaacagagaaaatagaggcctctaaacagaagaaggagcaaggaaattctctgttcaaggttggaaagtaccagcgagctgcaaagaaatatgagaaggctgcaaaatatattgagcacgacagttccttcagtgccgaggagaaaaagcaatcaaaggttttgaaagtatcgtgtaacctgaatcatgcagcatgccgtcttaagttgaaagacttcaaggaagcagttaaactatgttcaaaggtgttagagcttgaatcacaaaatgtgaaggcattgtatagaagagcacaagcatacatagagacagcagatttggatttagctgaatttgatataaagaaagctctagagatagagccacaaaatagggaagtgcaactggagtataaaattttaaagcaaaagcaaattgaatataataagaaagatgcaaagctatatggaaacatgttcgcaaagctgaacaaattagaagcctttgaaggaaaggtattgtcttgagagccatcgaacctaacagagcaagggacaattactaaacgaaaggctttttttgtgtatttactatttttatagtttgtaaactgaatcactgaagcaatggttcgaacataactgttcaatttttgccaactcttgggcagatactctttttaggccttactttcacacctagttttgcatggtttatggaaacttatattgctgtttttctttgcaactaggattttttttttctttttaatgaaagctgttccatgttacaagttgccagcgtgtctactgtcgttggcttgcaaagacatcttcttatcttattccgtgtctccataatcaccggcttctttagttcacctttgcaattataagcaagaagcttgactttggtgaaagtcttggaaattttgtagcttcgttgcttctgtattaaattccaagcagaagggcacatgttgtgacatcaagtagtagattgttctgcagattctggtttctattcttttctttcgttatactatatgacaatcgaatggacaaaggaatttcatcgaaaaaaaaaa

SEQ ID NO: 163 - DNA, 2417 bp, Pinus radiata
attttccattcactctgaatatcaatctcccccaacaaaagcccatggagatttcacaggtcacctttacctagggaagttccttcagctttggcagtttaacttaaaactacaaggctccatgatataacaacgtggcaatcctaacatgtaatttcattgccaaaatccgacgtggatcaactgaactggacagcccctgctgtaaataaagctctcggagtcttgaatcgtttacaaatattggcagacgaatggtcacaccaggcagtttatcggccttttacggtctcaatttgtaggcgttgggcgttgcaatacgtgtattctcagtagtctcatttgaaggaaaaatcaatggcagacgaaggtcttgaactctccgatgtagcagaagtcgaagatgaaccaggtgaggagttcgaatccgctccacccctcgttgtagggcaggagaaggagttaaacagctcgggtttgaagaaaaaacttctgaaggctggcacaaggtgtgaaacgccagaaaatggagacgaagtaacagtgcactacactgggactttactggatggtaccaagttcgattcttcgagagacagaggagagccctttactttcaacattggccaaggccaagttatcaaaggatgggaccaaggcattgttaccatgaagaaaagagaacatgcactattcacgatacctccagaattggcctatggcgcttctggcatgccacctactatacctcccaatgccaccctccaatttgatgtggaattactttcttggactaatattgttgatgtatgtaaggatggtggcattctcaagcgaataatatctgatggagaaaaatatgaaagacccaaagacccagatgaggtgactgtgaaatatgaagcaaagcttgaggatggaatgctcgtggcaaaatccccagaagaaggcgtggagttttatgtcaatgatggaaacttttgtcctgccattgtgaaggcagtcaaaacaatgaagaaaggagaaaatgtgactcttaccataaaacctgcgtatgcctttggtgagcagggtaaggatgctgaagaggggtttgctgcaattcctccaaacgctactatcactataaatctgcaattagtttcatttaaagctgttaaagaagtaacagaagataagaaggttatcaagaaaatcctgaaggaagctgatggatatgataaaccaagtgatggaacggtagttcagatcaggtataccgctaagctgcaagatggcacaatctttgagaagaagggatatgcaggcgaggagccttttcaatttgtagtagatgaagaacaagtgattgctggtcttgacaaggcagtggaaaccatgaagacaggggaggttgctctgattacaataggacctgaatatggttttggaaatattgaaacccagagagatctggctgtaattccaccatattcaactctcatctatgaggtggaaatggtatcatttaccaaggaaaaagaatcatgggatatgaatacaacagaaaacattgaggcctctaaacagaagaaagagcaaggcaattctctgtttaaggttggaaagtacctgcgagctgcaaagaaatatgataaggcagcaaaatatatcgagcacgacaattccttcagtgctgaggagaaaaaacaatcaaaggttttgaaagtatcatgtaacctgaaccatgcagcatgctgtcttaaactgaaagacttcaagaaagcagttaaactttgttcaaaggtgttagagcttgaatcacaaaatgtgaaggccttgtatagaagagcacaggcatatatagagacagcagatttggatttagctgaatttgatatcaagaaagctctagagatagagccacaaaacagggaggtgcgactggagtatcttattttaaagcaaaagcaaattgaatataataagaaagatgcaaagctatatggaaacatgtttgcaaggcagaacaaattggaagccattgagggaaaggattagattatccactcagatagttgtatatcaactagaaactactgttgggaatggcctgaggagactgattaaatgttcctagcacgcaaaaagctgcatttagttgattagcttcctgttttgactgacatttgcggaagggtgaaggtgaaccgatggaggtggagaagccaacaaagagttgatgaaaacagaaagccagaggcaacgggtgtagattctaattaaatagcagcatgttaatgtaatacatttagtttttagataactgttaatgtgtagtaaagcactaggaagagaaagatttggacatgtcattgtattttgacacttgaacggaagcatgttaaagaacctgtgttattgttttaaaaaaaaaa

SEQ ID NO: 164 - DNA, 1166 bp, Pinus radiata
gtcttttcttggctgtattttctgtctttgaagcggtattttgtacgcgaagcttgtttttgttgctggttttggtggctttaagcgggttttgtatgctaagcttgtttttattggcggttttggtagtctttaaagcggttttgtccaatcgcttctgtgcaggttgatcaatttggcggaaagtcaggcttttggtgcagctttttgcagaatctcagaggtttcgaactcaggatgccgaacccaaaggttttctttgatatgcaggtcggcggtgccccagccggccggatcgtgatggagctctatgcggatgtggtgccaaagacggctgagaacttccgcgcgttgtgtaccggcgagaaaggcaccggccgctcaggcaagcctctgcacttcaagggttcgtcgttccaccgtgtgatcccagggttcatgtgccagggcggtgacttcacaaggggcaacggtaccggtggagagtcgatctacggcgagaagtttgccgatgagaactttgtaaagaagcacacggggcctggcatcctctccatggccaacgccggccctaacactaacggctcccagttcttcatctgtaccgcccagacctcgtggctggatggtaagcatgtcgtatttggtcaagttgtagagggcttggaggtcgtgcgcgatatcgagaaggttggatctggatctggcagaacttcaaagccggttgtcattgccgactctggacagctcgcttgaatttttattatttaccttcgcctttacgctgcatacgttaataggttattatttccttcaaccattacgctgcataggttgttagcgtattgtttccctttaccattacgctgcatgactccctagggtttgtcagcataggcgttttaagggttttttgcatctttctactcaagatagtcgctgcataagttcctagggtttgtcagcaaagaggcttcaaaggtttttgtgtcttttctagttattataaacgcttcataggttcctagggtttgtcagcatatagatttcaagggtttttttagatctttggagttgagataaacgctatggcaataacccagtaatgtttgtttttatcatatgaaatttttacatctggagttgcattcgcagtaaaaaaaaaa

SEQ ID NO: 165 - DNA, 1287 bp, Pinus radiata
gaagaaagtaaggttttgtagcgaagaaagtaaggttgatcaatttggcggaaagtcaggcttttggtgcagctttttgcagaatctcagaggtaagcggtctttgaaaaatgaaaataaacaaatcgtctgagaaagtaaaaccttaaagcctttcaaggaaaagaactgaactttttggctttgaagaaaaatgatctttttgtctctgaacggcctgatatgaaagatccatgtaaagctcggcaggattttgtttgtgccttgcaggtttcgaactcaggatgccgaacccaaaggttttctttgatatgcaggtcggcggtgccccagccggccggatcgtgatggagctctatgcggatgtggtgccaaagacggctgagaacttccgcgcgttgtgtaccggcgagaaaggcaacggccgctcaggcaagcctctgcacttcaagggttcgtcgttccaccgtgtgatcccagggttcatgtgccagggcggtgacttcacaaggggcaacggtaccggtggagagtcgatctacggcgagaagtttgccgatgagaactttgtaaagaagcacacggggcctggcatcctctccatggccaacgccggccctaacactaacggctcccagttcttcatctgtaccgcccagacctcgtggctggatggtaagcatgtcgtatttggtcaagttgtagagggcttggaggtcgtgcgcgatatcgagaaggttggatctggatctggcagaacttcaaagccggttgtcattgccgactctggacagctcgcttgaatttttattatttaccttcgcctttacgctgcatacgttaataggttattatttccttcaaccattacgctgcataggttgttagcgtattgtttccctttaccattacgctgcatgactccctagggtttgtcagcataggcgttttaagggttttttgcatctttctactcaagatagtcgctgcataagttcctagggtttgtcagcaaagaggcttcaaaggtttttgtgtcttttctagttattataaacgcttcataggttcctagggtttgtcagcatatagatttcaagggtttttttagatctttggagttgagataaacgctatggcaataacccagtaatgtttgtttttatcatatgaaatttttacatctggagttgcattcgcagtactctcctggtcatcgagaattttttatgttttttttaatgcgtttaaaatatgcttaaatgggtccggaaaacaaaaaaaaaa

SEQ ID NO: 166 - DNA, 1118 bp, Pinus radiata
gaagaaagtaaggtaagaggattttgttagcgaggggtattctctggtgggcttggtagtcttaaaagcggtgcttttattcgtcttttcttggctgtattttctgtctttgaagcggttgatcaatttggcggaaagtcaggcttttggtgcagctttttgcaaaatctcagaggtttcgaactcaggatgccgaacccaaaggttttctttgatatgcaggtcggcggtgccccagccggccggatcgtgatggagctctatgcggatgtggtgccaaagacggctgagaacttccgcgcgttgtgtaccggcgagaaaggcaccggccgctcaggcaagcctctgcacttcaagggttcgtcgttccaccgtgtgatcccagggttcatgtgccagggcggtgacttcacaaggggcaacggtaccggtggagagtcgatctacggcgagaagtttgccgatgagaactttgtaaagaagcacacggggcctggcatcctctccatggccaacgccggccctaacactaacggctcccagttcttcatctgtaccgcccagacctcgtggctggatggtaagcatgtcgtatttggtcaagttgtagagggcttggaggtcgtgcgcgatatcgagaaggttggatctggatctggcagaacttcaaagccggttgtcattgccgactctggacagctcgcttgaatttttattatttaccttcgcctttacgctgcatacgttaataggttattatttccttcaaccattacgctgcataggttgttagcgtattgtttccctttaccattacgctgcatgactccctagggtttgtcagcataggcgttttaagggttttttgcatctttctactcaagatagtcgctgcataagttcctagggtttgtcagcaaagaggcttcaaaggtttttgtgtcttttctagttattataaacgcttcataggttcctagggtttgtcagcatatagatttcaagggtttttttagatctttggagttgagataaacgctatggcaataacccagtaatgtttgtttttatcatatgaaatttttacatctggagttgcattcgcagtaaaaaaaaaa

SEQ ID NO: 167 - DNA, 1084 bp, Pinus radiata
ctctggtgggcttggtagtcttaaaagcggtgcttttattcgtcttttcttggctgtattttctgtctttgaagcggtattttgttgatcaatttggcggaaagtcaggcttttggtgcagctttttgcagaatctcagaggtttcgaactcaggatgccgaacccaaaggttttctttgatatgcaggtcggcggtgccccagccggccggatcgtgatggagctctatgcggatgtggtgccaaagacggctgagaacttccgcgcgttgtgtaccggcgagaaaggcaccggccgctcaggcaagcctctgcacttcaagggttcgtcgttccaccgtgtgatcccagggttcatgtgccagggcggtgacttcacaaggggcaacggtaccggtggagagtcgatctacggcgagaagtttgccgatgagaactttgtaaagaagcacacggggcctggcatcctctccatggccaacgccggccctaacactaacggctcccagttcttcatctgtaccgcccagacctcgtggctggatggtaagcatgtcgtatttggtcaagttgtagagggcttggaggtcgtgcgcgatatcgagaaggttggatctggatctggcagaacttcaaagccggttgtcattgccgactctggacagctcgcttgaatttttattatttaccttcgcctttacgctgcatacgttaataggttattatttccttcaaccattacgctgcataggttgttagcgtattgtttccctttaccattacgctgcatgactccctagggtttgtcagcataggcgttttaagggttttttgcatctttctactcaagatagtcgctgcataagttcctagggtttgtcagcaaagaggcttcaaaggtttttgtgtcttttctagttattataaacgcttcataggttcctagggtttgtcagcatatagatttcaagggtttttttagatctttggagttgagataaacgctatggcaataacccagtaatgtttgtttttatcatatgaaatttttacatctggagttgcattcgcagtaaaaaaaaaa

SEQ ID NO: 168 - DNA, 2206 bp, Pinus radiata
ggaatcgcttgatgcataatataaaatcactcgcttccccctctttctttcgcctagccgtttcattggttgtttgctaagaattcagagtgtcgtactgcgcatctgcttggcttttgattctgtttatcttcgttaacatttcaagtgtgtaattttcctcagcaacgttccaatggcggacgattttgaactccctgaaagtgctggaatgatggaaaatgaggactttggcgatactgttttcaaggttggtgaagagaaagaaattgggaagcaggggttgaagaaattgttggttaaagaagggggatcgtgggaaacacccgaaaccggtgatgaagttgaagttcattacaccggaacacttctggacggtacaaagttcgattctagtcgggatagaggaactccattcaaattcaagcttggtcaaggtcaagtaatcaaaggatgggatcaggggattgcaacgatgaaaaagggggaaaatgcagtcttcaccattcctcctgatctggcatatggggaatctggatcgcaacctacaattccacccaatgcgactctgaaattcgatgttgaattgctctcttgggctagtgtaaaagatatctgcaaggatgggggcatttttaagaaaattatcaaggaaggggagaaatgggagcacccaaaagaagctgatgaagttttggttaaatatgaggctagactggaggatggaactgttgtatcaaaatcagaggagggtgtggagttttatgtaaaggatggatatttctgtccagcttttgccatagctgtcaaaacaatgaagaagggagaaaaagtattgttaacagtgaagcctcagtatggttttggacaccaaggacgcgaagcaattggaaatgatgttgcccgttccacaaatgcaacattgttggtggatcttgagcttgtgtcttggaaggttgtcgatgaagttactgatgataagaaagtgctgaagaaaatcctgaagcaaggagaaggttatgaacgacctaatgatggggcagtggtcaaagtgaaatacacggggaagttagaggatggcaccatatttgaggaaaagggatctgatgaagaaccattcgagtttatggctggagaagagcaagttgttgatggattagatagagcggttatgacaatgaagaaaggagaagttgccttggtgagtgtggcagctgaatatggttaccaaactgagattaagacagacttggcagttgttccaccaaagtccaccttgatttatgaagtggagctggtttcatttgtaaaggagaaagagtcatgggacatgaacaccgcggagaagatagaggcagctgggaagaagaaagaagaagggaatgcattatttaaggtcggcaagtattttagggcatccaagaaatatgaaaaggctacaaagtatattgagtatgacacttcattcagcgaggaagagaagaagcagtcgaagcccttgaaggttacttgtaatctgaacaatgcagcttgtaaactcaaattgaaagattacacacaagcagaaaaattatgtacaaaggttttggaggttgaatcgcaaaacgttaaggctttatatagaagagcacaagcatacattcagacagcagatttggagctcgcagagctggacataaagaaagcactcgagattgaccccaacaacagggatgtgaagctcgagtacagggctcttaaagaaaaacaaaaggagtacaataagaaggaagccaaattttatggcaacatgtttgcacgaatgagcaagttggaggaattagaaagcaggaaatctgggagccaaaaagtggagactgctaataaagaggaagggtctgatgccatggctgtagatggcgagtctgcctgaagtgcttttgcaagtttagcgatatatttctatgcagtcctttatagatgagtctaccttttagccattcacaatgaagattgtaagttgggtgaacttttttaccacgctaggttgatctattttaagactcttttgcaagatgcttctgcattcatagcaaaattgtatgagggactggcaagctgaatttgcttgaaagtgatgaaagaggatgtatttttgaagtattgccttgctcttagtctaattgacttagataatgaatctcttggtttttgttgaaaaaaaaaa

SEQ ID NO: 169 - DNA, 1096 bp, Pinus radiata
aacaaaatagctgcgcgtaccacaaaggtgacaaacgccggatttctcttatcagacttgtcaatggccgcctctctcactccactgggtgcaggcctggcttatgcaacaatttatgatcaagctaaagtgaggaaattggaacccacaaaacggtccttgatagcgctgtgccaacattccgattctcaacatagaagatttattactagaaaatatcatgtgaacgttcaaattcttaatcgaagagatgcaatcagattaattggtttagcagctggactatgtattgatctttctctgatgtatgatgctagaggagctggtttacctccacaagaaaatgcaaagttgtgtgatacaacgtgtgagaaggaacttgaaaatgctccaatgatcacaactgaatctggtttacaatacaaggatatcaagattgggaatgggccaagtccacctattggatttcaggtggcagcaaactatgtagcaatggtaccatctggacaagtttttgatagttcattggataagggtcaaccttacatctttcgagtaggttctggccaggtgatcaagggtcttgatgaaggccttctgagcatgaaagttggtggaaaacgtcgcttgtacatccctggccctcttgcattcccaaagggccttaactctgctccaggaaggccgcgggtagcacctagcagtcctgttatttttgacgtgagtttggagttcatacctggccttgaaagtgaagaagagtaaactgcttgcatgacagattagcaagtcaagtcattgcgtagagtgatggtcaccatagactctttagtttcattcatttgattgattattctttttataaaatttgtttccgttttccttgtttggaagaaggcttactgttttgaacttgaaaatatgttgaaataggttaaatgcactgttaattctggacggatggaaggatttcctttccaatcatttccttgcaacaaagagctgaccacggcaagcttaagcatctgatgaatgatgccacatgtatatcttttcttaatataatatatatcaagcttttttcgtaaaaaaaaaa

SEQ ID NO: 170 - DNA, 1147 bp, Pinus radiata
gtgtgaatccatttaagtctatccaaaggccaaacaaatctgaaagaattttgtttaacacattatccatttacgggacagggcaagcagcaatgtcggccgcatcactttctgcagacatggcgatccgtggcactattctggggaagacagcattacatgttttgggacctcaggttgtatcccaatgtcgccaaccagtgatgttcaaatgtccaccccatactctcaggaagatgagattttctgctcaagatttgcagtcaaaaaatttctattcaggatttacaccatttaaatcagtttttatttctacttcaaaaaggagttggcaagcaggttctgccagagctatgtcacaggatgctgcatttcagtcaaaggtgacaactaagtgctttttggacattgaaattggaggagatcctgcaggaaggattgtgcttggactttttggtgaggatgtaccaaaaacagctgagaatttccgcgcactatgtacaggagagaaagggtttggatacaaaggatcttcatttcaccgaatcataaaagattttatgcttcagggtggagactttgacaggggagatggtacaggaggaaagagcatatatggtcgcacttttgaagacgagaacttcaaattagcccatgttggacctggagttctaagtatggctaatgctggccccaacacaaatggcagccaattttttatatgtacagtcaaaaccccatggttggataaacgccacgttgtgtttggacaagttattgaggggatggagattgttaagaaactcgagtcggaagaaacaaatcgtacagatcggccaaaaaggccctgcagaattgttgattgtggggagcttccctgaagttgctgaaacagaggctttaattgtttcaattgagtgatcatctgaaaataattttgtttcgtctgaaaagaggctttaattatcatagttttattccggctatcttgatcattcacggaagtcccgagagtcaatttgccaagtattcctattaaactctattgctctcagaattgatttaaatgcctttaatgggtgcaatgtaatagtcttattatgagtcaatatgaactgttagggtaatgccaaaaaaaaaaaaaaaa

SEQ ID NO: 171 - DNA, 1745 bp, Pinus radiata
gctagatttcgtcgagggaagtcgagtcggagacaaattcgggtataatatggaggatgggtgagtcagaattgggtaaaaatagaagggaagacagaggatcaccccaaaacatatttgtctgattgatcgattgatttctaaaaggtccaacgttgttttctgctcctccacaaccaaatagttcatctccccatctcctgcttttcagattcactatacattcaaaattcgaaattcgatattcgggactgtgtaatcgaaggtctatctatttcaaggtccccagatcgatcttactccgaaggagaatcgtttcgatcatctttgctgaaagtgagagcagaaacctttgagacaagtcaggggcaatggggagaattaagccacagacattgttgcagcagagcaaaaagaaaaaagtacccggccgtatcagcgtttccaccattatagtgtgcaacttgatcatcatctttcttatgttttctctagtgggcatctacaggcagagggccaagcgtaatcgggcaacatctcggtctgatggtgatgaggaaatggagaactttgggaggtccaaaataaacagcgttcctcaccaagcaatcgtaaatactacaaagggtttaatcacattggaactttttggtaaaagttctgcgcataccgttgaaaagtttgtggagtggagtgaacgtggttacttcaatggattacccttctatcgtgtcattaaacactttgtaattcaagttggagatccaaagtttgctggaaacagggaagactggactgttggtggtcagctcaatgttcaacttgagttcagtccaaagcatgaagcattcatgctggggacctccaagttggaggatcagggagatggatttgagcttttcataacaacagcacccattccggatttaaacgataagcttaatgtctttgggcgtgttataaaaggtcaagatgtagttcaggaaatagaggaggtggatacagatgaacattttcagccgaaatcccccatcatcattaatgatgtccgtttaaaggatgagctctgagacatacgtgcagtcctgtttcaagaaattgtgatcgataatcagtttttcttccaagtattgcttttcgcctgttctgtctcgagcattttatatacccggaggaaacagcgctgtggataccaggaagattgaagtgtatgtatatttaggcaaatacttcgtaagttttgtgatgtctcagttgttggcttttacctgtagagaagttgagttctaagctggagatttatttctttaccacctgaatattctcatagttctaggccaattataattctttagtcccttcttatgttggggaatgaaatttactgttattactttacactgaatgatcattaatgtgcctcaggattttagcatctcagtttgccgctgaacatttgacaagagatttaatgattaagatttcttttgacattgggagagattttttctaacttgcgttgagacaaaatgacaatgaactgcaatccactttcgacaaaaaggaagagatcaagaatcaagtttgatgggctgaccccatgttaacttattagttattatagtggaggttcccatttccaagtcaaacagtttggatacccacttaatgataccagtataactattaatttttgtaaagccaccaagcttgtataaatgatgcctttcttttcaaaaaaaaaa

SEQ ID NO: 172 - DNA, 756 bp, Pinus radiata
ctttcaaagggacgggttgcgagaaatatggcgaggcaaagtactctactgctcttttggagcttagtattcttgggtgccatcgtatttactcaggccaagcatgaggaactggaagaggtaacacacaaggtatactttgatgtggatattgctggaaaacctgctggtcgagttgttattggactctttgggaaagctgtacccaaaactgtagagaattttcgggcgctttgtacaggtgagaagggcgttggaaaaagtggaaagccacttcattacaagggaagttttttccataggatcattcccagcttcatgattcaaggtggtgatttcactcttggagatggcagagggggagagtcaatctatggaactaaatttgccgatgagaacttcaaactgaagcacacaggaccagtttttattaccacagtaacaaccgactggttggacggcagacatgttgtctttggaaaaattatttctggaatggatgttgtatataaagtagaagcagaaggaagacagagtggtcaaccaaaaagaaaagtaaagattgcagacagtggagagctttctatggattagctaactcttctagttgagatctccatcaattaatggatacaaacattgagtttcactttggcaaaccgacattcccaaatttaatgagccaatatgtttggctcgtcataaagcctgggataatcttaaataataaatatcgagttggtgactcaaaaaaaa

SEQ ID NO: 173 - DNA, 813 bp, Pinus radiata
gaacgactttcaaagggacgggttgcgagaaatatggcgaggcaaagtactctactgctcttttggagcttagtattcttgggtgccatcgtatttactcaggccaagcatgaggaactggaagaggtaacacacaaggtatactttgatgtggatattgctggaaaacctgctggtcgagttgttattggactctttgggaaagctgtacccaaaactgtagagaattttcgggcgctttgtacaggtgagaagggcgttggaaaaagtggaaagccacttcattacaagggaagttttttccataggatcattcccagcttcatgattcaaggtggtgatttcactcttggagatggcagagggggagagtcaatctatggaactaaatttgccgatgagaacttcaaactgaagcacacaggaccaggattcctctccatggcaaatgccggtcctgacacgaatggctctcagttttttattaccacagtaacaaccgactggttggacggcagacatgttgtctttggaaaaattatttctggaatggatgttgtatataaagtagaagcagaaggaagacagagtggtcaaccaaaaagaaaagtaaagattgcagacagtggagagctttctatggattagctaactcttctagttgagatctccatcaattaatggatacaaacattgagtttcactttggcaaaccgacattcccaaatttaatgagccaatatgtttggctcgtcataaagcctgggataatcttaaataataaatatcgagttggtgactcaaaaaaaaaaa

SEQ ID NO: 174 - DNA, 1853 bp, Pinus radiata
gtggccaatgagattactgaagctgaagacggatatacaacccggaccacattcccaattgaatttgtagcagctcttgtgcatgcccacgtagttctgacatcaaatttaggacgcaacataatgtattcaacttcgcatttcttcttctaacgaccagcggttttctcccttgaagtgaggcttcgtgtcatttaataactaggtagggttttcagaagtggggttcatcgcatttgccagtacttgcaatggtacagcggagagaagggggtgcgaggtacaatattgaaaatggcggatcgtgattatgcgaggacaatattggtcaaattgaattgactggatctcatggttagagagcttagtgggatcgagacgctacagagacaatatacaggaggggtctctcgttcatcactctagacagtgtgtaactgcacttcaacaaatatattttagaaagaatctctgctatttatggagatggacgagattcaggaacagtcccaaccccaatccagtgagaagcaggatatttctcaagaatctgacacaggcaatgataaaacaattaatgctgaaaagatcacatccgagaatgctgaagttgaggaagatgatatgcttcctccaaaagttaatactgaagtggaagttcttcatgataaagttacaaaacaaatcatcaaggaagggagtggaaacaaaccttcacggaattcgacatgcttcttgcactacagagcgtgggctgaaagcactatgcacaagtttcaggacacctggcaagaacaacagccactcgaactggttttgggcagagagaaaaaagaattgagtggctttgccattggtgtggctggcatgaaagctggtgaacgtgccttgcttcatgtggactggcaattaggttatggggaagaagggaacttctcttttccaaatgtaccacctagagccaatcttatatatgaagctgagcttattggttttgaggaagccaaggaaggtaaggcacgtagtgatatgacagtagaggagcgaattgaagcagcagataggagacggcagcaaggtaatgaacttttcaaggaggacaaattagcagaggctatgcaacagtatgaaatggccctagcatacatgggagatgattttatgtttcagttgtttggaaaatacaaggatatggcaaatgctgtgaagaacccttgccatcttaatatggctcaatgtttgttgaagctgaaccgttatgaagaagccattggccaatgtaacatggtattagctgaggatgagaagaatatcaaggctttattcagacgtggtaaggcaagagctactctagggcagactgatgatgcaagagaggactttcagaaggttcggaaattttctcctgaagataaggcagtgatacgagagttgcgtctccttgctgaacatgataagcaggtttatcagaaacagaaggagatgttcaagggtctttttgggcaaaaaccagaacagaaaccaaagaagttacactggtttgttgtgttttggcagtggcttctgtcgatgataagaactatttttaggatgagatccaaaactgactaattaattatggttcaatttgccgatcttgttaataataaatataacttaatttgtctgttgccaataagatctatgcaacaatgctattcgacttggaagttgtgaagtggatcactactggattccgttacattagttattgcaagttggttattatgtacgtttatatcacagaactttgacaattgtctgtgaactacagtattaaatagttttggtgcttgttactcttaaaaaaaaaa

SEQ ID NO: 175 - DNA, 991 bp, Pinus radiata
cttttttcattaatttggttatgagttcgccatcttgtatactataaccgggcaatgatgtttgtcactcagtggtgaggaaagggagaacaatggcaggagcaggagaaggaactcccgaggtcaccctcgagacctccatgggtcctatcacagtggagctctaccacaagcacgcccccaagacctgcaggaatttcttggagctctcaagaaggggctattacaacaatgtcaaattccaccgcgttatcaaggatttcatggtgcaaggcggagacccaactggcacaggaagagggggggagtcaatttatggcccaagatttgaagatgaaattacccgagatttgaaacatactggagcgggaatattgtccatggctaatgcaggtcctaacacaaatggcagtcaattcttcatttcactggcaccgacaccatggcttgatgaaaaacacactatttttggaagggtatgcaaagggatggatgttgtcaaacggcttggaaatgttcagactgataagaatgatcgacctattcatgatgtgaaaatcttacgaacaacagtcaaagactgataaattccatatcaagaaggtcaacagctcctatcagactacgttggatcatctgttgcaggttactgcaatttttagacttctttttattatgcttcatcctttaatgcatccttcagtgaagcaactactattgatgttttggctctaaaaatatagacttcgtttatttaaaattttcccaacataaaatatgaaagacctaaaacagaatctcgtgaaatttgcattagaagatgttacctatattttgtatatggtttcagtggagtttcctgatgtgcagattacaccatgaacaaatgcaattaccctgttttattctatcccgctttaattaatattggtcatgtttttcttattctggcttgggaatttggttggcagatttacaaggtattgtcatt

SEQ ID NO: 176 - DNA, 2295 bp, Pinus radiata
gctctattatagaccagcttcatcataaggtaaagtttggcgagccgcgtggacttattctttgacctttttggccaataaatttcaatccccgaaccattcggtcatcgaaattctccccgagatcgctctgtaattccatgccatttgagcccttaatttgaattgtttctttcaagcactgtattttaatttttcccggtgaagtgttagtgttggtggattttccgctgacaatcgaatcagggaatgatggatccggagttgatgaggctggcacaagagcagatgagcaagatttcccccgatgaactcatgaagatgcaacgacagataatggccaatccagacttaatgcgtatggcatcagagaatatgaagaatttgaagcctgaagatataaggtttgcagcagagcagatgaaaaatgtacgcaaggaagaaatggctgaaataagtgagcgcatatcaagggcttcaccagaagagattgaagcaatgaaagctcgtgcaaatcttcagtctgcatatcaattacaagtagctcagaacctaaaggatcagggaaatcagcttcatgctcgaatgaaatacagtgaagcagcagagaaatatttgcaagcaaggaacaatctgacaggaatacccttctccgaagctaagagtttgttattagcttcttcctcgaatttaatgtcctgctacctaaagactgggcagtacgaggagtgtgtacaaacaggttcagaggttctggcatatgatgcaatgaatgttaaagcattgtatcgcagaggccaagcctacaaacaaattggaaagctagaattggctgttgcagacttaagaaaagcggtggaggtttctcctgaggatgaaacaatagcacaggctttaagagaagcaagcacagaattaatggagaaagggggcactcaagatcaaaatgggcctcgtattgaagagataattgaggaagaagctgttcagccaactgctgaaaagtatccgcagtcggctcctatggtgacttctgttacagaagatgtaagtgatgatgagcaggggtcagaagatcaaaatgggttctctagagatagctttcaagcaactaatgcgcccgatgggcagatgtatgctgagagcttgaggaacttgactgaaaatcctgacatgttaagaactatgcagagtttgatgaaaaatgtcgacccagactccttggttgcactaagtggaggtaaattgagccctgatatggtcaaaactgtatctggtatgtttggtaggatgtcaccagaggagatccagaatatgatgaaaatgtcgagcaccttatcaagacaaaatccatctacttcatctagatttgatgacatcacacgtggacattcaaacatggattcatctccacaatctgtttcagtagataatgacctttttgaagaaaatcagaatagagttggggagtcatctacaaatttgagttccagtgcagccttctcaggcatgccaaacttttctgcagaaatgcaggagcaagtgagaaatcaaatgaatgatccagccaccagacagatgtttacgtcaatgatacaaaatatgagccctgaaatgatggcaagtatgagcgagcagtttggggttaagctttcacctgaggatgcagttaaggcacaaaatgctatggcctctctttctcccaatgacttagacagattgatgaattgggcaacaaggcttcagactgcaattgactatgctcgaaagatcaagaactggatactaggaaggccaggtcttatttttgcaatttccatgcttcttcttgctattattcttcatcggtttggatatattggagactaagaaacgatacatcatttggattttcaaatattgatgtagttgatgcgtgcttaaaccaattgaggaagctacttcaggcatgcattttgatcctttatgaccttatttccagcaatgccagccgtatagttaactgagaaatgctgggaactctgctggaattatttgttaacaaggaagcagttgacttttgcttgtggattgtactgtggtacatggtataaatctataggctatgtcgattatttttggcatcctcatgccttttattaaaaacacacggatgcttgagaatgatgttttcctttgtgttaggtcagtttttgtccaaatcatgtggcacctttggttaataacattatccacatcaatttgtacatgggatcttcttacgtttatttttatttttttaaaaaaaaaaaaaaa

SEQ ID NO: 177 - DNA, 587 bp, Pinus radiata
acggacgacttccattttttccacgtgaatccaattgttcgctagcttttaaaggaattggttttacgcacataaaaagaagaatgggagtagagaaggagattttgaggcctggtaatggccccaagccgcgtcctggccagagcgtgacggtccattgcacaggctacggtaagaatgaggatctgtctcagaaattctggagcacaaaagatccaggacagaagcctttcacattcacaattgggcaagggagagttattaaaggatgggatgaaggcgttttggacatgcaactaggagagatttttaaacttcggtgttcaccggattatggatatgggtcaaatggatttccagcatggggtatacggccgaattctgttttggtttttgagattgaagttttgagtgtaaactagagtactatatcattatagaatatatgatatataagatataagatattgccagcaaactatttgacaggttatttaataaagtgtgctacattttcattgtattttgattaagatttctaaggtatgatggatggtgtttgtagtaaaaaaaaaaaaaaaaaaaaa

SEQ ID NO: 178 - DNA, 1728 bp, Pinus radiata
aattaacgaaggaatcaggccctaagcctcaagcttcggccaaccatagtcataacaacacaactagggttttaagcttttggcatgttaagtctggtccacaagtaagaggttcgaatccgcggagatgccgaatccaaggtgttacctggacatcactattggggaggagctggaggggaggatcttggtggagctttacagcgatgtggtgcccaaaacggccgaaaatttcagggctttgtgcacaggagaaaagggcattggtcctcataccggcgtccccctgcattacaaggggcttcctttccatagagttatcaaaggttttatgatacaaggtggagacatctcagctcaaaatggtacagggggtgaatcaatatatggattaaagtttgatgatgaaaactttcaactgaaacatgagcgcagaggaatgttgtcaatggcaaactctggacctaatacaaatggctctcaatttttcatcacaacaacaaggacctcccatctggatggaaagcatgttgtctttgggaaggtaattaaaggcatgggagttgtgcgcggcattgagcatactcccacagaaagtaatgaccgcccttctctagatgttgtaatttcagattgtggggagatcccagaaggatcagatgatggaatagctaatttcttcaaagatggagatttgtatccagactggccagctgatcttgatgagaaatctgcagaaatttcatggtggatgaatgcagtagattctgcgaaatgttttgggaatgaaaattacaagaaaggggattataagatggctttaagaaaatacagaaaggcattgcgctatcttgacatttgctgggagaaagaagaaattgatgaagagaagagcaatcatttaaggaagaccaagtcgcagatatttacaaatagttctgcttgtaaattaaaattaggagatttaaaaggtgccttattggacacagagtttgcaatgcgtgatggggaagataatgtaaaagcattattccgtcagggtcaggcatacatggctctgaaagatgttgattctgctgtagcaagcttcaagaaagcattgcagttagaacctaatgatgccgggattaggaaagagcttgcagttgccacgaagatgattaatgacagacgtgatcaggaacggagagcctatgcaaggatgtttcaatagcctatcttatcatttttgtccgcatgtagtttaggatattaggaagagtttagggaaaggacaggcatttgatatctctcattggactatatcgggattcctttttaaaagtacccagtgatataggaactgagcaagaggcaaacaaattcaaatcagggttgagccacgattttacattttaacgaatatgatgataacatggtttgtcaaggtcttgcagcaatgtcttgcagcatcgccaatgtcaagtgtgaataatgaaggaaaatattttttcaattgattgaacatgggcagcattttgaaattaattcccttttaaatgtggacagaggcactataagaatgcgaaatatcgtcggagcacgactaattgttttttaacttgcgcttttcttttttaggcgaatgtgaaaaattccttgctggtagatattgttgagttataatggacaaaaatagagccagtgagcaatggtgatttttcttaatgaaaaattgatattattgcc

SEQ ID NO: 179 - DNA, 1045 bp, Pinus radiata
cgaaatagtggaatgcgtattgatatggctaagagttctctctgcaattctcagaaaccctggcagataattaagctcaacgctgctactgttagcgtcagttaccttggtggtagacaagaacaagaagcgcaagtagtatctagagcaacagaagctgtggattcacacggccgtcatttgacagtgccttccagtgtgttcacctctgcatcatctcagatttgagcccagtcttaattacctgaattatagacagaaaatatgggggatgtaatagatctaaatggagatggaggtgtgctgaaaaccataataaggtcagctaagccaggtgctatgcagccaactgaagatcttcccaatgtcgatgtacattatgagggcaccctcgcagatactggtgaggtatttgatactacccgtgaagataatactctcttctcatttgagttgggcaagggcacagtaatcaaggcttgggatatagctgttaaaaccatgaaggttggtgaggttgcaagaattacttgcaaacctgaatatgcttatggaagtgctggctctcctccagatattccagaaaatgcaacactcattttcgaggtggagttggtagcatgcaaaccacggaaaggttcaacttttggcagtgtttcagatgagaaggccagactagaggagctgaagaaacagagagaaattgctgcagctagcaaagaagaagaaaagaaacgcagggaggaagccaaagcaacagcggctgctcgtgttcaagcaaaattggaggcaaagaaagggcaaggtagagggaaagggaaaagcaagggaaaatgatagactagttctacaaagccctaggatgatggacttcatttcttttgcattaagatgaagttataaatataaacttcaatatattattttttggtttgcttcccacttgattaaaaaccaaaaaggtccatctaaatttttgttttttggatgatatgtttgtgcaatgtaactgtttacacttctcggtttttgcttaaaaaaaaaa

SEQ ID NO: 180 - DNA, 1004 bp, Pinus radiata
aacacattgaaaataatatttgtatttttccactgacatgggactcggtttaaaaattgcctctgcatcgtttcttcccatattcaacatcatggcgactcgttctctgtgtatcctgctggtctgcttcatccctgttctcgcacatgttttatcgcttcaagatccagagcttggcacagtccgtgtatattttcagactacatatggtgatattgaatttggatttttccctcacgtggctcctaaaactgtggaacacatttataaacttgtacggcttggctgctacaattccaatcacttttttcgggttgacaagggctttgttgctcaagtggctgatgttgtaggtgggagagaagttcctctaaattcagaacaacggaaggaaggggagaaaactattgttggtgaatttagtgaagtaaaacatgttcggggaattctttcaatgggaagatatagtgatccagatagtgcatcatcctcgttctctattcttctaggaaatgcacctcatctagatggtcagtatgcggtttttggaaaggtaaccaaaggggatgatactcttaaaagattagaggaagtgcctactcgccaagagggaatttttgtgatgccattggagcggatcaggattctttcaacatactactatgatactaatgaaagagaatcaaacttgacctgcgaccatgaagtgtcaattttgaaaaggagattagtagaatctgcttatgaaattgaatatcagagaagaaagtgccttccatgagaagttgaaccgtctttttatagatcttttcaaagatgagtgttgggcttttctagcatacttgattcttccatttatattcgaacataaattttgtttgtttatttgattccaattatgacattagttccatgttaaatgctagatttcttatggggttggaacattcctcgctgccttctggtaatattaggttatgcgtttttcattctgaaaaaaaaaa

SEQ ID NO: 181 - DNA, 857 bp, Pinus radiata
cataactgtaaagccagagcagagagagagtacaacgatggcgagcaagaggagcctgagaacgatgaatgtttggccaacgctaccgccattggtcctcctgctactcttatgcttctcttccatgtcaagttcagtggttgctaagaagagtgatgtctcagagctacaaattggagtgaagcataaaccaaaatcatgtgatattcaagcccataaaggtgatagaatcaaggtgcactatcggggatctcttacagatgggacagtttttgactcaagctttgagaggggtgatccaatagaatttgaacttggtagtggccaagtaattaaaggatgggaccaaggacttctaggaatgtgtgttggagaaaagcgcaagttgaggataccttccaaattgggttatggagcacaaggctcccctcccaagattccaggtggagcaacgcttatatttgatacagaacttgttgctgttaatgggaaaggcattagtaacgatggtgatagcgatctgtaaataagattgctccattttgctttaaagggcggagttcatactttagaaagcgaacttgaagcaacttaattttaacaggttacataatctattgtagcattctcttgaaatgggaaattgaggttgactgtgtacttctccagtggacaggagaaagcgataaaattcaaacgttgttgtcattatttccttcgctgagtgacatgtgatacaatgaaagggagtctgaaccgtctttgttgacctttattattactcgatgtatatttcttcccactaaagaggcaaaatattctattttaaattgaaagactttaaattaaaaaaaaaa

SEQ ID NO: 182 - DNA, 1189 bp, Pinus radiata
cgaaaccttctgaaatttcagttgtcatcgcgcgctatgtctggggcacctgcagagcgtcctatctcttactttgacatcaccatcggcggcaagcccattggccgcatcgtcttctcattatatgcagacctagtgcccaagacagctgaaaactttcgtgcattgtgtacgggtgaaaagggtatcggaaagtctggcaaacccctttgctatgctgggtctggctttcaccgggtaatcaagggtttcatgtgtcaaggtggtgacttcacagcgggaaacggcactgggggagaatcgatctacggcgagaaattcgaagacgaggcgttccccgtgaagcacacgaagcctttcttgctgtccatggcaaatgcaggaaaagacaccaatgggtcgcagttcttcatcactgtgagccaaaccccccaccttgatgacaagcacgtggtattcggtgaagtgatcaaaggcaaatcaatagtccgtgcgattgaaaactaccctactgcttcgggagatgtacctacttcccctatcatcatttctgcatgcggcgttctctcccccgatgatccttctcttgcagcttctgaggaaacgattggcgacagctacgaggactaccctgaagacgacgattcagatgtgcagaatcctgaagttgcgctggatatcgcacgaaaaatccgtgagcttggtaacaagctcttcaaggaagggcaaatagagctcgcgctcaagaaataccttaaatcgatacggtatttggatgtgcatcctgtgttgccggatgactctccaccggagcttaaggactcgtatgacgcacttcttgcgccccttctattgaactcggcgcttgctgctctgcgcacgcaacccgcggacgcccaaactgcggtgaagaacgccacgcgagctttggagcgtctggagctgagcgatgcagataaagccaaggccctttatcgcagggcgtcagcgcatgttatcctcaagcaggaagatgaagctgaggaggaccttgttgctgctagccagctttcacctgaagacatggcgatctccagtaagctcaaggaagtgaaagacgagaagaagaagaaaagggaaaaggagaagaaggcattcaagaaaatgttttcgtcgtgacatacatcgtaatcattggaagtataccagt

SEQ ID NO: 183 - DNA, 994 bp, Pinus radiata
aaatggagggaatgaagttgaaagaatactgcgcaaacagagaacaaaaattggtggacaatggcttcttcactccgcagttctcttttttcgtcatgggctttggattccaagtctgtatgctccctatttaacctcaatccagggaagatggggctgccttccatttctacgccactgaattggaggacttgctgctgttcacacagttctgaattgttggagctaaatgaggggctccaatcttctagaaggaaaactgtgatggggttatccaccgtaatagctttaagccttgtttattgtgatgaagtaggagctgtatccacaagcaaaagagctctaagatcacagaaggttccagaggacgaatacacaactcttccaaatgggctcaaatactatgatttgaaagttggaagcgggacggaagctgtaaaaggttcacgagttgcggtacactatgtagccaaatggaaaggtatcactttcatgactagcaggcaaggcatgggtattactggtggcactccttatggatttgatgtgggtgcttctgaaagaggagctgtcttaaagggattggacttgggagttcaagggatgcgagttggaggccagcgcatacttatagtacccccggagcttgcatatggtaatacaggaattcaagagatcccaccaaatgcgactcttgagtttgatgtggagttgattagcatcaagcaaagtccatttgggtcaagtgtaaaaatcgttgaagggtagttgtgaaattgattaaattgctaataaatattgttgtaattcattatcatcatgtttcttataatttaagagctatgaaacaactaccttttggaatggttttgtttcttataatttaagagctatgaaacaactaccttttggaatggttttgtttttagcatcccaattatatttacaatgctttgaaaaatcaataaaataagtttctatttaaaaaaaaaaa

SEQ ID NO: 184 - DNA, 2415 bp, Pinus radiata
gcgaagcaagcaaaccaaataccagcagctcgagggtttggttgtcgttcctctttccctttgcattttcaaacgatctgggcgcctccttaacaataacatatcagtttctgctttccctatacattttcgaagttcgggaaatctgtatggcgcaaatctgaaccttggccgtggaaaatccacagagctccggcggaaaacagaggaggcggccttgaaacgcttataaacaggcttggatagccatattgatcggtgttcaggcaaggaggaattccagatcctgcacttcttagaaggtttccgtcttttgttacattttaattttcaccagaaggattaatcacctgcgaggtgcatttcaccctcttttggttggaaacatttatgggctaaattgtggcgtgtgaacgtttcatgggagccattgaggatgaagaaccacccctgaagcgtttaaaggtgtcctcacccggcttgagaagaggtttggaggaggaggccccttcattgtctgtggggtcagtgagcatcttaatggccaaatcattgtctttggaggagggtgagacagtaggttccaaaggactcataaggagggtggaattcgtaaggataataacacaagctctatattctttgggttaccagaaagctggtgcgcttttggaagaggagtcaggaatacttctccagtcttcaaatgtagctttatttagaaagcagatactcgatggaaagtgggatgaaagtgttgttacactgcggggtattgatcaagtggaggtggaaggaaacacactgaaggctgcatcctttctgatcttgcagcagaagttctttgaactattggacaaaggtaacatccctgaagctatgaaaacacttagattagaaatttctccaatgcaattgaacacaaaaagagtacatgaacttgcaagctgcattgtgtttccttcacggtgcgaggagcttggatattcaaagcaggggaatccaaagtccagtcaacggatgaaagttttgcaagaaattcaacaattattaccaccttctataatgatcccagaaaagaggctggaacgtttagtggagcaggcccttaatgtgcagcgagaagcatgcatttttcacaactccttggatccggccctttctctatatactgatcatcaatgtggacgagatcaaattcctacaacgacattacaggtgttagagtcacataaaaatgaagtgtggtttctacagttttcaaacaatgggaagtatttggcttctgcatcaaaagattgttctgcaataatttgggagataactgaaggggattctttctccatgaaacatagattaagtgcacaccagaaaccagtttcatttgttgcttggagccctgatgataaactgctgcttacatgcggtattgaggaggttgttaagctttggaatgttgagactggtgaatgtaaactgacctatgataaagccaacagtggattcacttcctgtggttggtttccagatggtgaacggtttatctctggcggagttgataaatgcatctacatatgggatcttgagggaaaggagttagattcatggaaaggacaaggaatgcccaaaatatctgatctcgcagtcacatctgatggtaaagaaataatcagcatatgtggggacaatgctattgtgatgtacaacttggatacaaaaactgaaaggttaattgaggaggaaagtggaataacttccctatgtgtatcaaaggacagtagatttctcctcctaaaccttgcaaatcaagagatacacctctgggatattggagctcgttcaaagttattgttaaagtataaaggtcacagacaaggtcgctatgtgataaggtcctgttttggtgggtctgatcttgcattcgttgttagtggtagtgaagactcacaggtatacatttggcaccgaggtaatggagaacttttagctgttttgcctggtcactctggtacagtaaactgtgtgagctggaaccctgtgaacccacatgtgtttgcatctgctagtgatgactatactattcgtatatggggtgtaaacagaaacactttcaggagtaagaatgctagttctagtaatggcgtcgttcaccttgcaaatggagggccatagccaagagagataaaagaccaattttgagcagcagtttaagcattgtaataacgctcattattcatttctgcacttgtaaattctgatcttacttcatttatttctattccaaagaccaagcttgtaaattatgctggttccatatgggggttaatcagtatcctcgttatttgtgacaccaaattatcaaatctcacaaaatttgtgaatgggactaaaaaaaaaaaaaaaaaaaaaaaaaaa

SEQ ID NO: 185 - DNA, 1918 bp, Pinus radiata
ggcatggtgcagatccttcgccgtcaaacacatgtacatgtaattttcaagctggactgatattcccctcctcattttccattaagaaaacgaatggaaatgcagtagaaattgttcagagactcgtagacagaggtttaaggaacatagatagatttagaaatgccgggaacaactgcgggtgcaggtatcgaacccatcgagcctcagtccctgaagaagctcagtctcaagtctcttaagcgctccttcgatctctttgcttcccttcatggcgaacctcaacctcccgatcaacgcagtcaacgaataagaattgcctgcaaggtgcgagctgaatatgaagtcgtaaagaacttgccaactttgccacaacgggaagttggcagttcagtatcaaactcaaatgttggagaaactcattcatctctgacaactaatcaagctcaaggatttccaactgacacatcaggagatttgtcgaaagatgaagggaaagagattactagcattgctgttcatttgcagccacaaacaggattgattgatggaaaggcaggagcaatagctggaacaagtactgctatttcttctgtgggttcttcagatcggtaccagccaagtgcggccatcatgaaaaggctacccagtaaatggccacgtcctatatggcatcctccttggaagaactatcgggttatcagtgggcatttgggctgggtgagatctgttgcttttgatcctggtaatgagtggttttgtactggctctgctgaccggacaataaagatttgggaagtagccacaggaaaactcaagctcacattaacagggcatattgagcagatacgaggtttggctgtaagttctcggcatccatatttgttttctgctggtgatgataagcaggtcaaatgctgggaccttgagtataacaaggctattcgctcttaccatggacatctaagtggagtttactgtttggcacttcatccgacattggatattctttgtactggtggtcgtgattctgtttgccgagtatgggatattcgcaccaaagctcaaatatttgcactctctggccatgagaacactgtgtgttcagtttttacccaagcaatagatcctcaagtggtgaccgggtctcatgatactacaatcaagttatgggaccttgctgcaggaaaaacaatgtctactcttacgtatcacaaaaaatctgttcgggcaattgcaaaacatccttttgagcacacttttgcgtctgcatctgctgataatataaaaaaattcaaacttcccaagggagagttcctgcacaatatgctatcacagcagaagacaattgttaatgccatggccatcaacgaggacaatgttcttgtatctgcaggtgacaatggaagcttatggttctgggattggaagagtggtcataattttcagcaggctcaaacaattgtacagcctggatctctggacagtgaagctggaatatatgcactccaatatgatataactggctctaggcttgtttcttgtgaggctgacaaaacaattaaaatgtggaaagaagacgagacagccactccagagagtcacccaataaattttaaagcgcctaaagatatcaggcgtttctaaatctttagttaattaattgtatttctattaaaattgggcattttagttgtatatgatctatagccttttatagagtgctaaatgaagaggtaatctttgtattcagctttgttgtgaactatcaatagacggggatggtcctttttagctgctccttaagcagctcaaatgatctgtaagaggtagagacgtagttgttgctgtattcaagtatgatacatcagcacagtaaagcatcttccttacaaagctattttattcaaaaaaaaaa

SEQ ID NO: 186 - DNA, 1896 bp, Pinus radiata
gcataagtgagttcatagtcttttgctcataaaatctatgaacaaaaacccttggaacacttacatggagggccttatatattcatttctttactcatcatcgcttctttttcgtctttcttcatcggtgccagtgctcgcggcttgtctacactgaagtccgataaggaacctaatacattgcaagcaagatgaggccgattttgatgaagggccacgagaggcctctgacgtttctcaagtataacagggacggggacttgctgttttcttgtgcgaaggatcacacgcccaccgtctggtatggacacaacggggagcgccttgggacctatcgaggacacaacggtgctgtctggtgctgtgatgtctcaagggactctacacgtttaataaccagcagtgcagatcagactgccaagttatggaatgtggagacaggagctcaactattttcttttaactttgaatccccagctagagcggtggaccttgccataggggataagcttgttgtaataaccacagatccatttatggagttgccttcagcaattcatatcaaacgtattgagaaggatctgtcaaagcagactgctgattctgtacttacaataaccgggatcaaaggaaggataaacagagctgtttggggccctctaaatagtacaataatcagtggtggagaagattctgttgttcgtatttgggactcagagacaggaaagctgctcagggaaagtgacaaggaaacaggccatcagaaacctataacatctttgtgcaagtctgcagatggatcccacttcctgacagggtccctagataaatcagccaggctatgggatatcaggactttaactcttattaagacgtatgtcacagagcgccctgtaaatgcagttgcaatttctccactacttgaccatgttgtgataggtggaggtcaggaagcatctcatgtgactactactgatcgtcgtgcaggaaaatttgaagcaaaattctttcataagattcttgaagaagaaattggcggggttaagggacactttggacctataaattcactggcatttaatcctgatggaaggagctttgcgagtggtggagaggacggttatgtaagattgcatcattttgatcctgattactttcacatcaagatgtaatttggtactttggaaagaaggcttggtctgtagcgtttctcattacatgatggattgccaggaattcacaaaaaatatcgcacaattggtgtcttgattatgtaagattctcgagaagtaggaaattttaagaggttttaacaaattttggggaggcttgattgatttttcagacagaattgtttgtatcttgttgggaattattactatttatatacttcagctgagctgggtcgtggtaaaaaaaaaaaaaaagggaaagcaaggtcctacaacaccactgcccgacttggtcaccattcatactccgaaagaagaggaggaattcgctgccaagccagtgcttggcaaggaaactgagatacttgtctaggtcacttttagttcattacatacaacatttatatttaagcttctaatatattcttgacccatccacatgaattcaattccggtcatatgtagacgactataatgttgtttgtgtcctataactatagtgttggatcaacgtcgttcaatttttgactattttttaacttcgatatgattgttgacgtgttaagggaggctctttagttctcaaggtgttaaagcttggggaattgtagtttctcaaggatgttagtttatttggcaacgacgctacttgttcatatttgaaattaattaaaatttcaagcgtggcatttaatttgccagttttctccttttaaaaaaaaaa

SEQ ID NO: 187 - DNA, 1489 bp, Pinus radiata
gaggataccgagttgattacttgcaatatttcttgttttgggcttccgcggttcttcagaattgaagagcgcttagggtttgttatttattgcagaagtccgataaggaacatagtacattgcaagcaagatgaggccgattttgatgaagggccacgagaggcctctgacgtttctcaagtataacagggacggggacttgctcttttcttgtgcgaaggatcacacgcccaccgtctggtatggacacaacggtgagcgccttgggacctatcgaggacacaacggtgctgtctggtgctgtgatgtctcaagggactctacacgtttaataaccagcagtgcagatcagactgccaagttatggaatgtggagacaggaaatcaactattttcttttaactttgaatccccagctagagcggtggaccttgccataggggataagcttgttgtaataaccacagatccatttatggagttgccttcagcaattcatatcaaacgtattgagaaggatctgtcaaagcagactgctgattctgtacttacaataaccgggatcaaaggaaggataaacagagctgtttggggccctctaaatagtacaataatcagtggtggagaagattctgttgttcgtatttgggactcagagacaggaaagctgctcagggaaagtgacaaggaaacaggccatcagaaagctataacatctttgtgcaagtctgcagatggatcccacttcctgacagggtccttagataaatcagccaggctatgggatatcaggactttaactcttattaagacgtatgtcacagagcgccctgtaaatgcagttgcaatttctccactacttgaccatgttgtgataggtggaggtcaggaagcatctcatgtgactactactgatcgtcgtgcaggaaaatttgaagcaaaattctttcataagattcttgaagaagaaattggcggtgttaaaggacactttggacctataaattcactggcatttaatcctgatggaaggagctttgcgagtggtggagaggacggttatgtaagattgcatcattttgatcctgattactttcacatcaagatgtaatttggtactttggaaagaaggcttggtctgtagcatttctcattacatgatggattgccaggaattcacaaaaaatcgcacaattggtgtcttgattatgtaagattctcgagaagtaggaaattttaagaggttttaacaaattttggggaggcttgattgatttttcagacagaattgtttgtatcttgttgggaattattactatttatatacttcagctgagctgggtcgtggtacaaacattttacaccctataacaaaatatagtgtcataagtttacaccaggtaacaactctatatccaaagctgcagttaaattgtccctgcccttctgtggaaggcttaatgaacatgtttaaggttcaaaaaaaaaa

SEQ ID NO: 188 - DNA, 2224 bp, Pinus radiata
ctgcgttatgtcatcgtcggtcataaaccccagggtttaagttgtctttatcaccctctgcctggctcgttagtgtagtgaacaccattatttcactgctaccataatatacagaaaatctcctagaatatacagaaaagacctcgaaatggcggagaataacgtcggcgacttcataccacttgatcgacaagagtacccttcaaaacccgctccaggcgccgttgactcgagcttctggaaatccttcaagaagaaggaagtttcccggcagattgcaggcgttacttgcatcaatttttgccctgaacctcctcacgatttcgcagttacatcgtctacccgggtacatatctatgacggtaaatcttgtgagctcaagaagacaatcacgaagtttaaagatgtggcatattcaggagtatttcgttctgatggacagatcattgctgctgggggtgagacaggggtcattcaggtcttcaatgcaaagtctcaaatggttctccggcaactgaaggggcatggcaggcctgttcgagttgtaaggtattctccacaggacaaacttcatctactttcaggtggtgatgatagcatggtcaagtggtgggatatcacaacccaggaagagttactaaatctagaagggcataaggactatgttcgctgtggtgctgcaagtccatcgagtgttaatttatgggctacaggttcatatgatcacacagtacggctgtgggacttgcgcaactcaaagactgttttgcaattaaagcatgggaaaccactggaagatgttttattttttccatctggtggattgctggccaccgcaggaggtaacgtagtgaaggtatgggacattcttggaggaggacgacccatacacacaatggaaacccatcaaaagactgtcatggctatgtgtatttcaaaagtacccaggtcgggccaggctttgggtgatgcaccttctcgtcttgttactgcatcactagatggatatatgaaagtttttgatcttgatcattttaaggtcacccattctgcaaggtatccagctccaattctatcaatgggcatatcctctttgtgtaggacaatggcagtaggaacctcatctgggcttcttttcatccgccagaggaaggggcaaatagaagataagatacattcagattcatcaggtcttcaagtaaatccagttaatgatgaaaaggattctgctgttttgaaacccaatcaatatcgttattatttacgtggtcgcagtgaaaaaccttctgaaggagattatgttgtgaaaagaatggcaaaagtgtatttccaagagtatgataaagatttacgtcacttcaatcattcaaaagctttggtttctgctctaaaagctgcagactccaagggtacagtagctgtcatagaagaactagttgctagaaagaggctgatacaaactttgtcaattctcaatttggacgagctcgagttgctaatcaattttttatccaggtttattcttgtaccaaaatattcaagatttctcatttcccttacagatagggttctggatgcacgtgcagtagatcttggaaagtcagaaaatttaaaaaaacagattgcagacctgaagggaatagtcgttcaggagcttcgagtgcagcagtccatgcaagaattgcaagggattattgagccactaattcgagcttctgctcgataaatgatctaaatggagagttttattcattacatgaaagagtatgtcacctttcgtgctccatctattgatttttatttttaaagcctagagaaaaaagtatttatcacaaaatgctgaagcatttttggttcaaggtttcgtgttcccttgtaatatttctgtttcagtggggctagctggaatgacatgttcatctatggaagaagaaacagaggaatttatgagggatcgagaaagagaatttatttcattatttctcatctcttgtttttgatgtgccgctcattcagtttgagcccttgtaacataatgttcggtcaatggcatggccattgaaacaattttggtcatgtgacgggcatacagaaaatttgtatctaagtatctatacttatctccaagtatagaagcttagtgagtcttattagttcttaaaatactaatttttctgcgatattttgcataaatatctaaatttataaggatttaaaaaaaaaa

SEQ ID NO: 189 - DNA, 2477 bp, Pinus radiata
gttccccaattcccatcaacgttttataagaattggtacgactttgcggcctgcggagacaaggtgggtctcgcatcatggcgttggaagaaagttcacgaggcagagcaaacagagaagagttcggagagcatattcatttcttcgattgtttattcgtctaagacgaacagtccgaggacatgtccggcggatgacttggtgaatttgttatcaaaattttcttaatactccgaaaggttcggtctcagcatttccctttaacatcttttatattttatttcagtagcagacacgaaccaaatcaaaatacccttcatacggcttaattctcagtcccgtaatttggcggtaatttgttttcccttttctgctcgatggtttaatgtcgatgaatgaagcagttgtgtttctgggctgctttcgggcagttctcatagggcggtttttaagatatccagggttagaaaactggttttcgacaggaaatctgctcacgatttcgacccttaaatcgaaagtgtacctggtttcatccagtttcttttttcaaaaatagaaattccgtattattctccaggtgaagcttacaatatcaggtttcttctcgtctggactatatcacggcaacactgaaatgtttgttagatgggaagccgagaaaagtttcggctatttgatagttagtttacatttaaaggcagcggagcagttttttttcacgaagggtttgatgtttaaagggagacaagcagttagttcgaaaggattgggtaacagtaacagtttgtttggtagacaggttcaggctttatttcgtatcgacccagatagcttccgggaattgagaatttgaagaatttaaacagacaattattgctgtcaaattacaggtttctggcatcagggtttcctgcaattagggtttactgatatcaggtaaagccatggacgtcgaaacctcagggaaacctacaggaaacaaaagaacctacacacgtctgccaaggcaagtatgcgtgttttggcaggaaggcagatgcactagagaatcatgcaattttctgcatgtcgacgaacctggatcagtcaaaagggggggagcaactaatgggtttgctccaaagagatcatataacggatcggatgagagggacacgctggccgcaggacctcccggaggatcgagaaggaatatttctgctagatggggaagaggacgaggtggtatattcatatccgacgagaggcagaagattcgcaataaagtatgcaattactggcttgcaggcaattgccagcgtggagaggaatgcaaatatttacactcctttgttatgggttcggacgtgaagttcttgacgcagctgtccggccacgttaaggctattcgagggattgcttttccttctgattctggtaaactctattctggaggccaagacaagaaggttatagtgtgggactgccaaacagggcagggtacagacatcccattaaatgacgaggttggatgcctcatgagtgaaggcccatggatttttgttggcctcccaaatgcggtcaaggcttggaatattttgacctcaacagaactaagtttagttggtcccaggggacaagtacatgctctggctgttggtaatggaatgctttttgctggaacacatgatggcagtatattggcttggaagtttagtcctgcttccaatacctttgagcctgcagcttcccttgtagggcatacccaagctgttgtttcattagtctcaggagcagacagactttactctggttccatggacaagacaataagagtttgggatttgggaacttttcaatgtctacagaccctgagggatcacacatcagttgtaatgtctcttttatgctgggatcagtttctgttgtcatgctctttagacaatacagtgaaggtctgggttgctacatcaagtggagcccttgaagtgacatatactcataatgaagaacatggtgttcttgcgctttgtggaatgaacgatgaacaagccaagcctgtcttgctttgttcttgcaatgataacactgtgcgtctttatgacctgccatcgttcagcgaacgaggtagaatattctcaagaaacgaggtacgaacattccagattgcacctggtggattatttttcaccggtgatgcgacaggtgaacttaaagtttggaactgggcaacccagaaatcctgatgcaacttaaaaaattcctgttgcaatcagggcactctgcttgaaatgcaaatctctctgggaactccttcacatggcagaaaggtgcagagtctggagaagttgaaatttcacgtcctgtatactcactcaagcaactttaggatgaagagctaaagtatatcaaagatatataagtgggtaatattaacactgaatagctgcaagtgatgcatgcttgatttccgtcaggaaaatcagaattttaaa

SEQ ID NO: 190 - DNA, 1924 bp, Pinus radiata
gtcctaatgactgatactggtttctggtttaccgtcatgtttcccggacccaagccgccggttttcagaacggctgatgctttctgaacccagagcggagagagcgagaccagggtctttggatttcgatctatggtcgagtccttcccttatgcgaaggttatgttccctaaatctgccaagaaaataattatttggcatatgacatagagctcggtttactgatttgcataccgaacatctctggttttgcttattttgctggttcaaatcagggtttcgatgcattctccataacattaacactcctgcttctgtaaattatcgagctatgtcggtgcaagagcttagggaacgtcatgcagcggcaacggcaaaggttaacgctctcagagagcggataaaggctaagcgcctccagctgttggatacagacgttgcaacgtatgccagcagtaatggaaggaccccaatcagcttcagcttcacggatctggtttgctgtagaacacttcaagggcacacaggaaaagtttattcattggactggacatctgagaaaaatcgcattgtgagtgcatctcaagatggacggttgatagtttggaacgctttgacaagccagaaaacacatgcaattaaactcccctgtgcctgggtgatgacatgtgcattttctcctagtgggcaggcagttgcatgtggtgggcttgacagtgtctgctccattttccagcttaacaaccagttagacagagatggacatctacctgtttccagaattcttagtggtcataggagctatgtctcttcttgtcaatatgttccagatggggatacacatgtaataactggctctggtgatcggacatgcattcagtgggacgtaacaacaggacaaaggattgcaatctttggaggtgaatttccattgggtcacactgctgatgttatgagtgtatccatcagtgcagcaaaccccaaggaatttgtttcaggctcttgtgatacaacaacccgtttatgggatacgcgtattgctagcagggccatacgaacatttcatggacatgaggcagatgtgaatactgtgaagttttttcctgatggactaagatttggatctggctcagatgacggtacctgtaggttatttgacatacgaacagggcaccaactgcaagtctatcgtcaacctcccagggaaaatcagtccccaactgtgactgcaattgcattctcattttctggtaggcttctatttgcaggatattccaacggggactgctttgtgtgggacacaatattggaaaaggtagttctaaacttgggagagttacaaaatacacataatggccggataagctgtcttggattgtcagccgatgggagtgctttatgtacggggagctgggacaagaatctaaagatttgggcatttggaggccaccgaaaaatagtctgattggtgagagattataaaaacgaaattcacttgaatgattagccttgcgaaaatgcactctttataaagtgggatgaggtatgtgtttccttcctattggctaacctgaattcctcctgcagccccaattattaaatgctatcctgcaacagtcatgattcgatgggcctaagctgtattgatattctcttgatcgttggagaaggcagatcatttgtaactttgtaatatgtattgatattttatttgtgttttctcattgcatttgagctgtgctacacaaaaatgatccttggctctatgattcccaattctcagttcaagtacatgtgaaggatctggagtttacagtcacatttccatattcaattatacatgaaagcttgtggatttgaatgaaaaacaatgtaattggtttagtatgttacaagtttatgattacaaggtttaaaaaaaaaa

SEQ ID NO: 191 - DNA, 1775 bp, Pinus radiata
ctgtcgaccccggtctgggatgatttcttaaaccctctcgacgccctttcttacgcttaaaaccctttcttcttttgttttcatcttcacaaccactggacagagatgttctgaccgcggattcactgagctattgctgaaccaaagatttttgcttcgcggctacccagggttgtgtgtccaaattgatattttccaccacgtttctgggtttttttgccctgtgaaataatgaaggtgaagataatatcacgttcaacagatgaatttacaagggaacggagtaacgatcttcaaagggtttttagaaactttgatcctaacctacatactcaggcaagggctcaagaatatgtccgtgctctcaatgcagcaaaattagacaagatttttgcaaaaccctttctggcagcaatgagtggacacattgatggcatttctgccatggcaaagagcccacgtcatttgaaaagcatattttcgggttccgtggatggagatatccggctctgggacattgcggccaggcgcacagttcaacaatttccaggtcatagaggagcggtgcgtggtttgactgtgtctacagaaggagggcggcttatttcttgtggagatgattgcacagttagactatgggatatcccagttgctggcattggggaatcaagttatggctcagagaatgttcaaaagccactagcaacctatgtgggaaaaaattctttcagggctgtagattaccagtgggatagtaatgtgtttgcaactggtggggctcaagttgacatttgggatcatgacaggtcagaaccgacaaacagttttgcttgggggtctgatactgtcatttctgtacggtttaatcctgcagagaaagatatatttgcgacaactgccagtgaccgcagtattgttctatatgaccttcgaatggcatcacctttgaacaagttaattatgcagacaaggaataatgccattgcatggaatccaagagaacctatgaatttcactgcagctaatgaagattgcaactgctatagctatgatatgagaagaatgaatatttcaacatgtgtgcaccaagaccatgtttccgctgtgatggatattgattattctccatctggtcgggagtttgtgacgggatcttatgatagaacagtgagaatattcccctataatgcaggtcacagcagagaaatctaccatacgaaacgaatgcaaagggtgttttgtgtgaaatttagtggtgatgcgacttatgttgtctctggaagtgatgatgctaatattcgtctgtggaaagctaaagcatcagagcagttaggagtgcttctcccgagagagcgcaaaaggcacgaatatctagatgctgtaaaggaacgttttaagcatcttccagaaattaaacgcattgagagacatcgacacctaccaaagcctatatacaaagcagcgcttctacggcatactgtaaatgccgcagcaaagaggaaagaggagcgtaagagagcgcacagtgctcctggatctgtggtcactaatcctcttcggaaaaagcgaattgtagctcaattggagtgaatatctaattctagcacgccaatgcaggttatactatgtattggagtgaaaatttaattatagtatatgctaattcaggttatactatgtattcaaaatatgttattgggcaatcgttattgattttacctatcgctatctcactgtccgccaatttagtgtaattctatgtaccaaaaaaaaaa

SEQ ID NO: 192 - DNA, 1832 bp, Pinus radiata
tctaggtggggtgttaggggaattgctcaccggattttgattttctggtctttttatgtgcgtggctcgtgtagtttgatactgaacattcaggaattgaagcttcttcacaaggattcggattttgatttgtttcagaaggtggggtacaagattcagtagcgaagttcagtgttttgccgaagggctctttcaaattaagtaagatggatcactactaccaagatgactttgattatttggtggatgacgagatggttgattttgctgatgacgtcgaagatgatgtacgcacccggcgcaggagtgatatagactcagattctgaaaatgatttcgatttaaacaataagtcacctgacacaacagctcttcaagccaagagaggaaaagatattcagggtattccatggaatcgattgaactttactagggaaaagtatagggaaactcgtttacagcagtataagaactacgagaaccttccacggccgcgacgcagtcgcaatctggacaaggaatgtactaattttgaaaggggatccagtttttatgattttcgccacaatacgagatcagtcaaggccactattgtccactttcagttgaggaatttagtgtgggcaacatcaaagcataatgtttacctcatgcagaattactctatcatgcactggtcttcactaaaacagaaaggggaagaagttcttaatgttgctggtccgatcgttccatctgtgaaacaccccggttcatcaccacaaggtctgacaagggtccaggtcagtgcaatgtctgtgaaggacaatttagttgttgctggtggttttcagggagaacttatttgcaagtatttggacaaaccgggagtgagcttctgtacaaaaatatctcatgatgagaatggcatcactaatgcagtagagatatacaatgatgcaagtggtgcaacacgactaatgactgcaaataacgacttggcagtacgagtatttgacactgaaaaatttacagtgcttgaacgcttctcttttccttggtctgtaaatcatacgtctgtcagtccagacggtaaacttgttgcagttcttggagataatgcagattgtttgcttgcagactgcaagactggaaagaccgtgggaactctaagaggtcatttggattactcttttgcagctgcctggcatccagatggttatattttggctacggggaatcaggacaccacctgcagactttgggacgttaggaagctttcatcttccctagctgtcttaaagggtcgaatgggtgctataagatcgatacggttttcatcagatggccgctttatggccatggcagagccagccgattttgtgcatctatatgatactaggcagaattatactaagagccaggaaattgatctttttggggagattgctggaatttcattcagccccgacactgaagcattttttgttggggtggctgatcgaacgtatggaagtcttcttgagttcaaccgtcgacgaatgaattactatcttgattccatcctctgagttttgaaagttaatgggagtggtgttttcttgaagtgaaatggcatcattctgttgaaccaattcttgtatattagatatgtaacatgtatgaatgtccatagagcagagctttgctcaatcagaggcttcaaaacccaaattccaaggtctatcgaagcctctttgtttataaatggtgttgtggtggatacagctttctggttcacgctgtagattttttaatgtatgtaacaatttcagcggatataaagtcttccaacttgtaaaccaaaaaaaaaa

SEQ ID NO: 193 - DNA, 1456 bp, Pinus radiata
ggaggatttggcacacgatcacctgatcattttcccaaccctaaaattcttatagctagggtttatccgaataaaaccctaaacacggcgcgcggtcttcttcttttattcgggactttttcgcagcagagcattacgataacgaaacacgagcagatcggcagcggccacccgccgaagaagaagaaaacccagtagtgcgatcagagtctgagcagccatggcggaagcactggttctgcgcggcacaatggagggccacaccgatgcggtgacggccatcgcgaccccgattgacaactcggacatgatcgtctcttcatcccgcgacaagtcgatcctcctgtggaacctaaccaaggagcccgagaagtatggtgtcccacggcgccgcctgactggccactcacacttcgtccaggacgtggtcatctcctccgacggccagtttgccctctctggctcctgggacagcgagctccgcctctgggatctcaacacaggcctcaccaccaggcgcttcgtcggccacaccaaggacgtcctgagcgttgcgttctccatcgataaccgacagatcgtttccgcctcccgtgaccgcaccatcaagctctggaacactcttggcgagtgcaaatacaccatccagccggatgcagagggccactccaactggatctcctgcgtccgcttttccccttcggccaccaaccccaccatcgtatcgtgctcatgggaccgcacggtaaaggtatggaatttgacaaactgtaagctcaggaatacgctcgtcggacacggaggctatgtgaacacggccgccgtttcgcccgacggttcgctttgcgccagtggcggcaaagacggggttaccatgctctgggatttggcggaggggaagcggctgtactcgctggatgccggggatattatttatgctctgtgctttagccccaacagatactggctctgtgctgccactcagcaatgtgtgaagatctgggatctggagagcaagagcattgtggccgaccttcggcccgatttcattcccaacaagaaggctcagataccttattgtaccagtttgagttggagtgcagacggaagcacattgttttctggttatacagatggaaaaatcagggtgtggggaattggacatgtttaagctttagaggcaatggtagattatgaagtcaacaccagggagtttgaccgtttgggacattaattttgtcgagcatgtgttcttttttcacaaaaattagtataatgcatttatgatttcagttttgatactatgttagaatttatttttctgcacggagggaaggcactccaagctttggaagcaatatttaatcaatgagcatattctatttcattaaaatggatatttaaggatctattgtatgaagtacaatgtttcagttttggcattttaaaaaaaaaa

SEQ ID NO: 194 - DNA, 3891 bp, Pinus radiata
gcatttttcattttatatccttcgaatccgtcattcggctgaatgatcagacaaaccctcgcagatcctgctctgttctgaagcataaacctccgccaaatccatgcgttgaatttcctgaaaaaattcgtggctattcagtgtcgaactgctatctccacagtcagatccagtggcgatcaaggtgaattagggcagaagaacgtgagatcgtgtacaaatggctgccataaaatccacgtctcgatccgcgtcggtggcgtttgcccccgacgcgcccctgttggcagcgggtacgatggccggagccatcgacttgtcattcagctccttagccaacttagagatcttcaagttggatttccagtccgacgatccggagctccccgtcgtcggagaatgcccaagcaacgaacgactgaatcggctttcgtgggggagcgccggtggctccttcggaataattgccggtggactagttgatggaaccatcaacatctggaatccagctactcttatcaattcggaggacaatggagatgcacttattgcacggcttgaacaacacacaggaccggttcgtggcctggagttcaatacaatttctacaaatttgttggcctccggagctgaggatggggagctttgtatatgggatcttgcaaatcctacagcaccaacccattttccaccattgaagggtgtgggatcaggtgctcaaggggaaatttcttttttagcttggaatcggaaggttcagcatatactggcttccacttcatatagtggaacaacagtggtttgggatttaagacgccagaaacctatcattagctttccagacgcaactcgaagacgatgctctgttttgcaatggaaccctgatgcttcaacacagcttattgtagcgtcagatgatgataattcacccactttacgggcttgggacttgcgaaacacaatttctccatacaaggaatttgtagggcatagcagaggagtcatagctatgtcgtggtgcccaagcgacagtttgttcttgctaacttgtgcaaaagataatcgcactctttgctgggacactggatctggggagatagtgtgtgaattaccagctggggcaaattggaattttgatgttcagtggtcgccaaagatacctggaattttatcaacatcttcttttgatgggaaaattggcattcacaatatcgaggcctgcagtcgaaatgtttctggtgaggttgagtttggtggtgctatagtacgcgggggaccctcagctctcttgaaggcccccaagtggttagagagacctgctggtgtaagttttggctttggcggaaagcttgcttcatttcgacccagtacggtggctcaggctgccgatcatagacattctgaggtctttatacacaatctagttaccgaggacaatctggttattcgatcaacagaatttgaagctgcaatagcagatggtgaaaaagtatcattgcgggctttgtgtgatagaaaagccgaagagtctcagtctgacgaagagaaagaaacatggaacttcttaagagtcatgtttgaagatgaaggcacggctaggacaaagctactcgaacaccttggatttaaagtgcagtcagaagagaatggggatttacaggaaactcattccagcaaaattgatgacattggtagtgaaataggaaaaactcttactcttgatgataaaacagaagaggatgtgttgcctcagctgaaaggtggacaagatgctgctatccctcaagacaatggagaagatttttttgataatttacacagtcccaaagaagaggtctctctttctcatgtaggaaatgattttgttggagaaaaggataaggatatggtagtaaatggtgcagagattgaacatgaaactgaagacttgactgaatattcagactggaatgaagctattcaacattccttagttgttggtgattataagggagctgttctacaatgcctgtcagcaaacaggatggctgatgctcttattattgctcaccttggtgggaattctttgtgggagaaaactcgtgatgaatatttgaagaaagctaaatcttcctatctcaaggtggtttctgccatggtcaataatgatcttacaggccttgtcaacagcaggccattgaaatcttggaaagaaactcttgctatgctttgtacatattcacagagggaggaatggactgttttatgtgatatgcttgcttctagattgatagcagcaggaaatgtgatggcagcaacactttgctacatatgtgctgggaatattgaaaagactgtggaaatatggtctcgaagtcttaagtatgattatgacgggaggagctttgttgatcatttgcaagatgtgatggaaaagactgttgttcttgctttagcaactggacaaaaacgggttagtccctctctgtcaaaattggttgagaattatgcagaattgctagcaagtcaaggacttctaaccacagctatggagtatctaaagctcctgggcactgaagaatcttctcatgagctgtctattttacgagatagactatacctctctgggacagataataaggtggaggcttcatcttttcctttcgaaacaaggcaggatctgacagaatcccagtacaatatgcatcaaacaggttttggggcacctgaaactcaaaaaaattatcaggaaaacgtgcatcaggttttacctagtgggtcatacactgacaattatcagccgactgctaatactcattacatagcaggctaccaaccggcaccacaacagcaaccttccttccaaaactattttactcctgcatcttaccagccagcaccatctccaaatgttttctatccatcacaagtttctcaagctgagcagagtaattttgctccacctgtgaatcagccaccaatgaaaacatttgttccatctacaccaccaatcttgagaaatgtagatcaatatcagacgccttctttgaaccctcaactctatcagggagtttcttcagctacagttgaaacacatccctaccaaactggtgcacctgcatctgtttcagtggggacaaccccagggcagccatctgtagttcctaatttcatggtcccgggaccagttactgcacctacagttactccccgagggttcatgccagttacaacaccaactcaacacccgctaggtagtgcaaatcctccagttcaaccccaaagtccccagtccagtcaggtgcagtctgtgacagctgcaaccacaccacctccaacaatacaaaatgttgatacatcaaatgtggcagctgaaattagacctgtaattggtacattaagaaggctttacgacgaaacatctgaagctcttggaggggcaagggcaaatccagctaaacggcgtgaaatagaagataattccagaaaaattgggtctttgtttgcaaaattgaactctggtgatatatcttccaatgctgcatctaaactggtgcatctctgccaagctctggagtctagggactatgcaactgcttttcaaatacaggtgggactgacaacaagtgactgggatgaatgcagtttctggcttgctgcccttaagcgaatgatcaaagtaaaacagaatatgagataaatttctgatggtgctacagttagattttttccaagtgccatttttacataatatgtgattagttattctgttcattattctgtttttcattcaatttgacattggagtttcaaggcattccaaggatagcatgtacacaagttgaatttttgcttgagagttattgcaatttttgtctttttgaggacattgtacaaaaaaaaaaaaaaaaa

SEQ ID NO: 195 - DNA, 1552 bp, Pinus radiata
gcacaggctatcttattttgaaatcattttgaaattcgtaccgtggcacgagggtgtttcaaacctagcgtcccaggccagcctccacacgttgtgtagcaaaaacaacataggtgtaagcggtgacacgatgagctgtcttgtttcataggactgcaagggcaaaggatatcagcgttggaatcaaatggcgggagccggagactcgcaattacaaacgagggctgcaagggcaaaggatatcagcgtctagtggaattggaatcaaatggcgggagccgcagactcgcaattacaaacgctatcggagagagacagcacccccaacttcaagaatttgcacaccagagaatatgctgctcacaagaagaaggtgcattcagtggcatggaattgtactggtaccaagcttgcttctggttctgttgatcaaacagcacgtgtttggaacattgagccacatggtcatagtaagaccaaagatttggagttgaaggggcatgctgatagtgttgatcaattgtgctgggacccaaagcattcagagttgcttgctactgcatcaggagacaggacagtgcgtctatgggatgctcgaagcggaaaatgttctcagcaggttgaacttagtggggagaacatcaacatcacgttcaaacccgatgggacacatattgctgtgggaaaccgggatgatgaattgactataatcgatgtccgcaaattcaagcctcttcataagcgtaaatttagctatgaggtgaatgaaatagcttggaatacaactggagagcttttctttctcacaacaggaaatggcactgttgaagtactgtcatatccttctcttcaagttcttcatacacttgttgctcacactgcgggttgctattgcattgccattgatcctataggaaggtactttgctgttggaagtgcagatgcccttgtaagcctttgggatctttctgagatgttatgtgttcgaacatttaccaaactcgagtggccagtgcggacaatcagcttcaatcatgatgggcaatacatagcttctgccagtgaggatctttttattgatattgctgatgttcagactggacggactgtacatcaaatatcttgtcgagcagccatgaatagtgttgagtggaatcccaaatacaatctcttggcgtttgctggagatgataaaaataagtacatgcaagatgaaggtgtgttcagagtttttggttttgagactccataaatgctctttaagttgacttggctcatgtggttatgcttcatcaaggacggcattttgaggctaataattattgtcagatttacaccataaaattactatggaagttggatcattatctatgccatagtggagtagaactagattttggggaacattgtttttgactcggacattgaaaaagtgactgcagattgcacatggcctcttctgtacctaaatcttttcaaatggagtcattggttggttatgtccaagccctgttagatggggcactttaaaatcaatgcaggctgcaaatgg

SEQ ID NO: 196 - DNA, 1525 bp, Pinus radiata
gatggggggaagtgggttcgtattcaaattggtgagctagcaggcccgccatttgttgatacataagcaaggtccgagggtatcaaaactggagctacagtgttaaaaatcacttttttagatatttaaaacagttcggcttatattggacagcgatcaaagtctgctagaagaagcgtcgatttaacctcaggaggaaagggggaggaaatcatggcggcaacgtctcccgttggtgccggctcgggacgggagctcgcgaatcctcccactgacggcatttctaacttgagattttccaatcacagcgaccatttgctcgtctcctcatgggacagaaaggtgcgattatatgatgcaagcgcgaattcgttaaagggtcaattcgtacacggaggtccggttttagattgctgttttcacgacgacgcatcgggtttcagtggaagtgctgacaacactgtgagaaggtatgatttcagcaccaggaaggaggatatattgggaaggcatgaagctcctgttcgttgtgttgagtattcatatgcagcagggcaagtgataacggggagttgggacaagacattgaaatgttgggaccctagaggtgcaagtgggcaggagaagactcttgttggtacatattcacaactggagcgcgtgtattctatgtcactagttggtcaccggttggtggtagccacagctggcaggcatataaatgtttatgatctccgtaacatgtcacaacctgaacaacgaagggaatcgtccttgaagtatcaaactagatgtgtgcgttgctatccaaatggaacaggttttgcccttagttctgtggaaggtcgcgtggctatggagttttttgatttatctgaagctggtcaagctaaaaaatatgcctttaaatgtcatcgcaagtcagaggctggcagagatactgtttatccagtaaacgcaattgcctttcatcccatctatggtactttcgccactgggggctgtgatggctatgttaatgtatgggatggcaacaacaaaaagaggttataccagtattcaaaatatcctacaagcattgctgctttatcatttagtagagatggtcgtttgttggctgtggcatcaagctacacatttgaggagggggaaaaaccgcatgaaccagatgctgtttttgtacgaagtgtaaatgaagctgaagtgaaaccaaagcccaaagtttatgctgcacccccatgaggcccgtctacattaatattctttcgtagagtatgctttctagtacatcttccttctcttcctgatgtacttgattgttacattgttactgtgttgggtatataagatacgagattctctgcttttgttggctgctatggtgtttcttttataatttaatactctatggattaatctcttgattctagaatctaaactactaccttgcggacatgactgagcatctctctaacagcttgggtgggacacctcactttttttaggggttttgtttgtactaaat

SEQ ID NO: 197 - DNA, 2427 bp, Pinus radiata
ccggactaattgacttacgccgctaaactctatactcacatttattctgtttgaagtcatttggctgggaaaatcgatcatcatcaaaagcttgcagcagttgagtcctcgagaattcatggcttcagacgacgaagaggggtttaaaaacgaagaggctccgggtgttgtcgatgaagcagaagtacaggagggtctgcgggcctgttttcctttgtcgtttggtaaacaagagaagaaacaggcccctttggaatccatccactccgccaccaaaaggccagaggatccacggcccagacgacagcttggtcctccaagacctccaccctctattttggcagaacaagaggattctgatagatttgtaggccctccaaggccgccccaattcgttagagacgacaatgacgatggtgaggcggagatcatgataggacctccaagaccgcctgctcagtatagcgatgaccatgataacgaggagaccataggtcctccaaagccttcatatttagaaaagggagaggagactgaccaaatggttggaccttccaaacgcggaagcgacgacgaaaccagcggtgattctgatgatggagacgatgctgtcgatttcagggtgcctttaagtaatgagattgtgctcagaggccataccaaggttgtttcagccttggctattgaccagacaggatcacgggttcttacaggtagctatgactattctgttcgtatgtatgattttcaaggtatgacttctcagctgaagtcatttagacaactagaaccagctgaaggtcatcaagttcgtagtttaagctggagcccaacttctgatcgatttttgtgtgtaactggatcagcccaggcaaagatttttgatcgtgatggcctcactttaggagagtttgtcaaaggtgacatgtatttgcgtgaccttaagaatacaaaggggcatatatcaggcctgacatgtggagaatggcaccctaaggagaagcaaacaatattgacatgctcagaggatggttctcttcgcatttgggatgtaaatgactttaatactcagaagcaggtcattaagcctaaacttgcgaaacctggaagagtaccagtgactgcttgtgcatggggtcgtgacgggaaatgcattgcaggtggtgttggtgatggatcaatacaggtgtggaatcttaaaccaggatggggaagcagaccagatttatatgttgccaagggacatgatgacgatatcacaggtcttcagttttctgctgatggaaatatccttctgaccagaagcactgatgaaacactcaaggtttgggatctacggaaggctataactccactgcaagtattcagagatcttccaaacaactatgcccaaactaatgtagcatttagtccagatgagaggttaatatttacagggacctctgttgaaagggatggtaattctggaggcttattatgtttctatgataggcaaacactggaattggtgttaagaattggtgtgtccccagtgcacagtgttgtacgttgtacttggcatccacggcataatcaggtctttgctacagttggggataaaaaagaaggtggagcacatatactatatgatccagctttgagtgagaggggggcacttgtttgtgttgcaagagcacccaggaaaaagtccttggatgattttgaagccaaacctgttattcacaacccacatgcccttcccttgtttcgagatgaaccaagtcgtaagaggcaacgggaaaaagcacgcatggatcccatgaagtcacagaggccagatttgccagtcacaggtcctggttttggtgggagggttggatcaacgaagggcagtttgttgacacaataccttctcaaggaaggggggctgattaaggagacatggatggaggaagacccaagagaggctatactgaaatatgctgatgttgctgcaaaagatcccaagtttattgcacctgcttatgcacagacacagccggaaacggtttttgctgaaactgattctgaggaggaacagaaatgatatataactgatgatgtgggtcatattcatccgggtctaccaatttccaatttcagggcaacatactattgaatagagtgcagttgacaaggcaaaaataagagagctggtccacattatcaaatttgcattatgacaaggccaaacaagagatcttgtctataatgttaaatttgtatattatctaactgattcttgtaatgtctgcaattgtataccaaacagggttgtgctagtttaacattttaacttaatgtaatcatgtaagctttagagaggtggcaagacattttcggtttatattatttataatttgtttatgaaatacttagtttattatattatcaatcctttctctattt

SEQ ID NO: 198 - DNA, 1825 bp, Pinus radiata
gcgagggtgcacgatatttcctatcgtcctgttactcgataaagcataaaccttgcaagctctgaactaggttgctttccatcagactgagctatttgagttacagtgaccaggaacagcaacaagtgatatctatagtgttgaaattgtgcgtggagtgagggtttaagggaacagaaaggacaatgaaggagagggggcagagtcatgcagggcaaccgtcggtcgacgaaaggtacactcaatggaagtcactggtgcccgttctctacgattggcttgctaatcacaacctcgtctggccttctctttcctgccgttggggtcctcaaatgcaccaagcaacatacaagaacagtcaacgcctgtacctttcggaacagactgatggcactgtgccaaacacattggtaattgctacctgtgaagttgtcaaaccaagggttgcagcagctgaacatatatctcagtttaatgaagaggcacgttctccttttgtaaagaagttcaagacgatcatacaccctggtgaggttaacagaatcagagaattgccacaaaacagcaaaattgtcgctacacatacagatggcccagatgtcctcatctgggatgttgatacacaaccaaaccgtcaggctactcttggggcagcagattctcgtccagacttggttttgactggacataaagataatgctgagtttgcacttgcgatgagtcccagtgcaccatttgtgctttctggaggaaaggacaaatgtgttttgctttggagtatacaagatcatatatctgctgcaactgagccttcctctgcaaaagcatcaaaaacaccatcttcagcacatggagagaaagtaccaaagatcccttcgataggtcctagaggtgtttataaagggcataaagatacggttgaagatgtgcaattttgtccttcaaatgcacaggaattctgtagcgtgggtgatgactctgctcttatattgtgggatgctcgaaatggcaatgaaccagtcattaaggttgagaaggcacacaatgcagatcttcattgtgttgattggaacccccatgatgagaatctaatcttgactgggtctgctgataactcagtgcgcatgtttgaccgccggaatcttacatccagtggggttggctcacctgtccataaatttgaaggtcattctgctcctgtgctttgtgtgcagtggtgtccagacaaagcatccgtgtttggaagtgcagcagaggatagttacttaaatgtgtgggactatgagaaggttggaaagaatgttggtaagaagacaccgcctggacttttcttccagcatgcagggcatagggataaggtggttgactttcattggaacagttttgacccatggaccattgtcagtgtatctgacgatggtgagagtactggtggaggaggaactttacagatttggcgaatgagtgatttgatatacaggcctgaagatgaggttttggcagaactcgaaagatttcgagctcatattctatcttgtcagaacaagtagagaatgttacgactacctcagtacttctttttttataattgtctataaactatgcaatgtaaatgtttacattgaggtcatgcatgagtgttaattacgctttcactactgttcacttttttctatagacagtggaaatggaatgatgttgatctggccatgtataggaaatctaatataaggatgtccaaagttgtgattggcatcaagtccaatccaaagttgtgaacaatattatatcggtattaaccactaaaaaaaaaaaaaaaaaaaaa

SEQ ID NO: 199 - DNA, 3487 bp, Pinus radiata
ctgatcttgagtgtcgaagaagaagattaaatggcgagcagtttcgaggcgtgagggcgtaggctgaaatctttagcctgaaacccttggctgaagtgttcgttcgacgaagctctgcggccgttaaagcaatcctccggaagttgtaagattttgtcggaaatcccggtatgcagggcttgctgtttgattgaatgttttggaacggacttggatagttaatgataaagtaaaactggcatcatgtcatctcttagtagagaattggtgttccttatcctacagttcttggatgaggaaaaattcaaggagtcggtgcataagcttgagcaagagtcgggtttctttttcaatatgaaatattttgatgagaaggctcaggctggtgaatgggatgaagttgagcgttatctctcaggctttacaaaggttgatgataaccggtattctatgaaaatattcttcgagatcaggaaacagaagtatttggaggccttggacagacaagaccgagctaaagcggtggatattttggtgaaagatctgaaggtattctcaacatttaatgaagaactatacaaggagataactcagcttctaacactggataacttcagagaaaatgaacaactgtccaaatacggtgatacaaagtctgccagaaccattatgatgtcggaacttaaaaaattgatagaggccaatcccttatttcgagaaaagctcatttacccaaacctaaaagcatcaaggttacggacattaattaatcaaagcttgaactggcaacaccaactttgcaaaaatcctagaccaaacccagacataaagacattgttcactgatcatgcatgtggacctcctaatggagcccggacacctacgcagcctacggcttctctgggggtgctacccaaagcaaccacatttacaccaattggaccccatgggccttttccatcatcttcaaccgctactagtggcttggcaagttggatgtcaaatcccaacatggtgacatctccccaagctcctgttgctgtgggacctagtgttccagttccacctaatcaagctactcttctaaaacgtcccagaacccctccaggcagttcatctgtggtggattatcaaactgctgattctgagcaattaatcaagcgcttgcgtcctgtatcccagtccattgatgaggcaacctatccaggtcctactctgcgagtaccatggtcaacagatgaccttccaaagacactagctcgggcacttaatgaaccttatcctgtcacaagcatagatttccacccctctcaacaaacatttttactagtgggcaccaaaaatggagaaataacattatgggaggttggttcaagagaaaagctggctacaaggtcctttaaaatttgggataatgcaaattgctccaatcatttggaggctgcatttgtcaaagattcttcagtttctatcaatcgagtattgtggagccctgatggaacattgataggtattgcttttacaaagcatcttgttcacacatacactttccaaggacttgatctgcgacaacacttggagattgatgcacatgttggtggagtgaatgacttagcattttctcatccaaataagcaactttgcgttgtaacttgcggagatgataagatgattaaggtctgggatgctgtaactggtcgcaagctttataactttgagggccatgatgcacctgtctattctgtttgtcctcatcacaaggaaaatatccagtttatattttcgactgccgttgatggaaaaattaaagcttggttgtatgatcatttgggatcgagagtagattatgatgctcctgggcattcctgtacaacgatgatgtatagtgctgatgggacaaggttattttcttgtggcacaagcaaagaaggagaatccttcctagttgaatggaatgagagtgaaggagcaattaagagaacatattccgggcttaggaagaagggttcaggtgttgtgcagttcgatacaacgcagaaccattttttagctgtgggggatgaacacctgataaagttttgggatatggacagtaccaatatgcttacgagttgtgatgctgagggtggtctactgaacctgcctcgtctaagattcaacaaggaaggatctcttcttgcagtgaccacagtaaatggaatcaagattcttgctaatgcagatggacagaaattacttaaaacaatggagaataggacctttgatttgccatcaagggcacacattgatgcacctgcaattaagccatgttgtaactggtcattcagatgcctggcggtattcccattgtcgcagcaagtgcaacttcgagtccagccactggaagaatggagcgcattgagagaacctcctcagccaatactgtttctggaattaatggagttgatccagcacagagttcagagaaactaaggttatcagatgatttatctgagaaaactaaaatatggaagctgactgaaattactgattctatccaatgtcggtgtataacattgccggagaatgcagcagagcctgcaagcaaggtttcacggcttctatacacaaattctggagtcggattactagctcttggatctaatgcagtgcataaattgtggaaatggaaccgcagtgagcagaatcccagtggcaaggcaactgcaagtgttcatccacagcgctggcaaccaaccagtggtcttctcatgaccaatgatataactgatataaatccagaagaggctgttccatgcatagctctgtcaaagaatgactcatatgtcatgtcagcatcaggtggaaaagtatctttattcaacatgatgacatttaaggttatgactactttcatgcccccacccccagcatcaacgttcttagcattccatccacaggataacaatatcatagctattggaatggaagattcaactatccacatatataatgttagggtagatgaggttaaaactaagttgaaaggacatcagaagagaatcacaggtcttgccttttccagtacacagaacattctagtgtcttcaggtgcagatgcacagctgtgcgtatggaacacagagacatgggaaaagcgtaagtcgaagactatccagatgccagttggaaagacagtttctggtgatacacgagttcaatttcattctgaccagcttcatatacttgttgtgcatgaaacacaacttgccatatatgatgcctataaattagaacgacaataccagtgggtgccacaagatgctctttcagcaccaatattgtatgcaacatattcatgtaataggcaacttatttacgcgacattcagtgatggtaatattggtgtatatgatgctgaaatacttagaccaagatgccgcatagccccaaccacctatttaagttcagggactagcagttctacctctttacccttggttgttgc

SEQ ID NO: 200 - DNA, 1704 bp, Pinus radiata
ggggacttcaaacaagccgtctttcactgcatgctccctttcccgcaaaacacaaaccaaacacgttaaactctaacccaaaccttctcgcaattcttaccaaatccagttactctgagccaaaacccttggcgggaaaaccccagttaggagcttccggccatggcgaaggacgaagaagaattccgcggcgagatggaggagcgcctggtgaacgaagagtacaaaatctggaagaaaaatacgccgtttctttacgatctggtgataacgcacgccctcgaatggccttcactcactgtacagtggctcccggaccgcgaagagccccctggaaaagattattccgttcagaaaatgatactggggactcatacttccgacaacgagcccaactatctgatgctggcccaagttcaactcccgctagaggatgcagagaatgacgccaggcagtatgacgacgagcgcggggagattggagggttcggctgcgccaatggcaaggtacaagtaatacagcaaataaatcacgatggagaggtcaatagagcccgatacatgccacaaaatcctttcattattgccacgaaaacagttagtgcagaagtctatgtgtttgactacagcaagcatccttcaaagcctcctcaagatggtggatgtcatcctgatctcagattgaggggtcataatacagaaggttatggtttatcatggagcccttttaagcatggccatcttttaagtggttcagacgatgcacagatctgtttgtgggacattaatgtacctgccaaaaacaaagtgcttgaggcccaacaaatatttaaggtgcacgagggtgttgtagaagatgttgcatggcatttaaggcatgagtacctttttgggtctgttggagatgaccgccatttgttgatatgggatttgcgtacatctgcaactaataaaccactgcactcagtagtagctcatcaaggtgaggttaactgtcttgcattcaatcctttcaatgagtgggtactggctacaggatccgcagacagaacggtgaaactttttgatctgcgcaagatatccagtgctttgcataccttttcctgtcacaaggaagaggttttccaaataggctggagccccaaaaatgaaacaatattggcttcttgtagtgcagacagaaggcttatggtgtgggacctcagcaggattgacgaattccaaacaccagaggatgctttagatggaccacctgagttgctgtttattcatggtggacatactagtaagatatcagatttctcatggaatccatgtgaggattgggttatagctagtgtagctgaagataacattctccaaatctggcaaatggctgaaaatatataccatgacgaggaggacgatatgcctcctgaagaagtagtgtaacttttatctagctagaagttgtgaaattaagagggatgtgaggattgggttataactagtgtagctgaagataacattctccaaatctggcaaatggctgaaaatgtatatcatggtgagggggatatggcttccaaagaaacattgtaagagctagctagaatttgtgaaattaagaggtgtattcactttcagagtttctcaacaaatgacatggttctcattccattttcttttatataatgagaagcaaaacttggcttaaaaaaaaaa

SEQ ID NO: 201 - DNA, 1699 bp, Pinus radiata
aaataagaccaccatttgttaccctctgcgaatcaccgtttatgctactaggaagcagatcgattgggataaattcatcctcttggctcgcatacagcttcccttccaacattcatctcgatgtaaattacagtcacagaactcatcaagcaatatgtctccaggagtgaagcaaacgggcagtcagaagttcgaatccggccaccaagatgttgtccatgacgtcacaatggattactacgggaaacgcatagcgacctgctctgcagatcggactataaagcttttcggcctgaacgcctccgataccccaagccttctggcctcgcttacgggtcacgaaggccctgtctggcaggtcgcttgggctcacccaaagttcgggtccatgctcgcttcctgctcatatgacggacgcgtaataatctggcgagagggtcagcaggagaatgaatggtcgcaggttcaagtcttcaaagagcacgaggcctctgtgaattcgatctcatgggcacccaatgaattgggactctgcctggcctgtggttcctctgacggctccataaccgtctttacatgccgcgaggatgggtcctgggacaaaacgaagatagatcaagctcatcaggtgggcgtgacggcagtttcatgggcgccggcttccgctcccggttcccttgtgggtcagccctcagatcccattcagaagctcgtttccggtgggtgtgataatacagctaaggtttggaaattttacaatggttcttggaagctagattgttttcctcctcttcaaatgcatacagattgggttcgggatgttgcttgggcgcccaatttagggcttcccaagagtactattgctagttgttctcaggatgggaaggttgttatatggacacaggggaaagaaggggataaatgggaagggagaattttgaatgattttaagatccccgtctggagggtcaactggtccttgactggaaacatcttagctgtcgctgatgggaacaacagtgtgactctttggaaggaggcagtagacggggattggaatcaggtgaccacagtacagtgacaaattcctaagagggagaattcaacattggatagctgatgaaaaaagacatcgaaggactatcagaatgtatgaattgcatgcaagagcaagaatgaatcaggcattaaagcgggaatcatttatgacttggcaacctgaaaattctattaaattcacaaaagtcatgacttggatgtttaaagaaaacagttttaagtaagctttggtcctctcttgtgagaatggtatggtggtacctttggctcaagcaaaacagttttatttttaaagagggtaagaaccaatcctggtatcagctaaagcccttttaaattaaggcttttatacacgatgactcagctgccaaccgaaatccaactgcttaatcaacttttagctcacccggaggatcaataaagagtctcttccaaccaattacagttcctccccttttgatgaaaggtttccttgtttttttgatgatcgttccaaggtagtccacatccccattatgctactagagtggttcttacttgagtgggatgtgtttttttttgtaaacaaagttgagtaagtatttcattaaaatctgtgcccagatgcaacaaatacccgagaaatcagataaaaaaaaaa

SEQ ID NO: 202 - DNA, 1659 bp, Pinus radiata
tttagctccacttgaaacctcgaccaaatataattttagttttagatctatacttgcgcatctcattccatcttctcaacaaggatacaggcctcgaccaaatataaatttagttttagatctatactgcgcatctaattccatcttctcaataaggatacaaggatacaggccgacgatggacggttgaatagataaatttctatagctcgaaatcatctgcttgttgtcggttgaatagataaatttctatagctcgaaatcatctgcttgtttctcctgcgagcttgcctctttttgatccacctcagctggtccagagaaaaacacgagatccgtgacaagggaagggcagcaattgcaaactggatcgaatttttactgccgaagctgctttcttccggatttgcggataaggttctagggcttccatcgcttggcaaatacgaagtggcttggtcttccagtttgttccttctcctcgggctggcagaagaagaagggcgacaacaaatatacagaactcatcgatcaatatgtcttcaggagtgaagcaaacggggagtcagaagttcgaatccgggcaccaagatgttgtccatgacgtcacaatggattactacgggaaaaggatagcgacgtgctccgcagatcggaccataaagcttttcggtatgaacacctcagataccccaacccttctggcctcgcttactggtcatgaaggccctgtctggcaggttgcctgggctcacccaaagttcggatccatgcttgcttcctgctcgtatgatcggcgcgtaatcatctggcgagagggtcagcaggagaacgagtggtcgcaggttcaagtcttcaaagagcacgaggcctccgtgaattcgatctcgtgggcaccccacgaactgggactctgcctcgcctgcggttcttctgacggctccataaccgtcttcacaggccgcgaggatggatcctgggacaaaacgaagatagatcaagctcaccaggtgggcgtgacggcagtttcatgggcgcccgcttccgctcccggttcccttgtgggccagccctcagatcccgttcagaagcttgtgtccggtgggtgtgataacacagctaaggtttggaaattttacaatggttcttggaagctagattgttttcctcctctgcaaatgcatacggattgggttcgggatgtagcttgggcacccaatttagggcttcccaagagcactatcgctagttgttctcaggatgggagggttgttatatggacacagggtaaagaaggggataaatgggaagggaaaattttgaatgattttaagacccctgtctggaggatcagctggtccttgactggaaacatcttagctgttgctgatgggaacaacaatgtgactctttggaaggaggcagtggacggtgagtggaatcaggtgaccacagtacagtgacaaatgtaagcttctttttacgattttgatttcttgacgttttaatatggtatggtattaaatttggaaggcctattcgattgtttgcaaaataataagtttgtctcgaaattgggttatcctatccaacttgttgtgtctattgttctaaagtttgtctcgaaattgggttatcctatccaacttcttgtgtcta

SEQ ID NO: 203 - DNA, 2175 bp, Pinus radiata
gtcttcttcatggtagagatagtgtccaacactaaaaataatccaattttctggttccaacctcaggatattttacttcagtcttttgtcagaatattgtcttctcctcgtgaaaacagtgtctaccactataaaatctccagtattctctgtgcctactataaatttccagtcttctctgttctggctttgttgatatgttgcttaaatcctcaagtgtcaaaggattttgcatagtgtttagcagcatttccacaagaagaagaagaggtgtttcaataagatgaagaaacggtcacgacccagcaatgggcacctatcgacggcagcgaagaataaaagccgaaaaactgcccctataacaaaagacccgttctttgactccgctcataatcgaaacaaaagtaaaggcaaaggcaaaagcagaggcaaaggagaagagattttcagcagtgatgaagacgacgacgctattggcagagatgctccagcagaggaagaagaggaaattgccgaggaagaaagggaaaccgcagatgaaaagcgcctcagggtggctaaggcctatctggataagatcagggccataactaaagccaatgaagaagataacgaggaggaggcgggcgaagacgaggaaactgaggcagagcgaaggggtaaaagggattctcttgtggccgagattcttcagcaggaacagctcgaagagagtgggcgagtgcagcgccagctagcctccagagttgtgacaccatcaaagctggtagagtgtcgagttgttaaaaggcacaagcagtctgtcacagctgtggcgctaacagaagatgatttgagaggattttcagcatcaaaagatggcactattattcactgggatgttgaaactggtgcaagtgaaaaatatgaatggcctagccaagcagtatctgtttcaagttcgaatgaagtctccaaaacacagaagggcaagggttcaaagaaacagggtagcaaacatgttttatcaatggctgtcagttctgatggccgttatttggcaactgggggtttagatcgttatattcatttatgggatactcgaacacaaaaacatattcaggcttttcggggtcatagaggagctgtgtcttgtttagcctttcgtcaaggcacacagcaacttatatcaggatcttttgatcgtacaatcaagttgtggagtgcagaggatagggcctatatggacactctttacggtcaccaaagtgaaatccttgcagttgattgtttgcgaaaagaacgagttctgtctgttggacgcgatcacactttgagactatggaaggtccctgaggagacgcagctggtcttcagagggcatgcagcatctttagaatgttgctgtttcatcaataatgaagacttcctatctggctctgatgatggaagcattgagctttggagtatgttgagaaagaagccagtttttatggcaaaaaatgcacatgggcatgctattgtagaaaatctttcagaagatacgagtactagggaagagccagatgaggaagtgacaacaagacaattacctaatggaaatagtattgggaatggtatgacaaatcaaatgggaatcaccccttccgtagagtcatgggttggagctgtcacagtgtgcagaggaactgatcttgctgcatcaggagctggtaatggggtggtacggttatgggctattgaaaatagcagtaaaagccttagagctctacatgacattcctctgactggatttgtcaattcacttacttttgcacggtctggacgctttcttattgctggagttggccaggaacctcgactgggtagatggggccgtattcaggctgctcgcaatggtgtgactttatgcccaattgagctttcatgatggattttgggggcaaatcaagatgatggtatctgtttgcatttccagcacagttctgattctttactagggtaactgtcacattcaacagagaatcccagaatggaaagcctcgcatacttaattattgttttgatgccttttcttataacctgtacgattgccgatatatcaccaattttgctgattttaatctgagtttgtagtgcgtacaaaaggctgctataaaaatattgaatttttagattccaagatcaaaaaaaaaa

SEQ ID NO: 204 - DNA, 1938 bp, Pinus radiata
ggtgaatatggcaaaacatacgttaaaaaatcgagggggaagatggatggatgttaaacatttgaactttcagacaaacagccttataaacccttcgtgagctatattaagatggatgtattctacatccctgaatacccaaacctactcaggcgtatcaagcgtacgataaaccatctctcagtcacctaccgtccgaggagaacagcggatttctatcagtagaatagttccattgacagacgacatttgcgactcggagcacagggctagagcaatttcaaggttttaagcagttttctggaggctcggatttggccagcaatacttgcaatactcaattggaggcaaagctaaggcaggagcccagggagacttgtacatgaaaaacttcgcagcctgcggttctgggagatttgaaggttgagcagttttagctattaaacatttcttctaaagcaagcttcgacagattctgtacagtgatagtttctgcggccttttaaacggggcagaattgagagattctaggtcgccgtaagtgcgattttaggcattcggctgtgcttcctcgtattgcgaaaagttaattaacagagagtttcttcaatggctgctaccttcggcaccattaatactgccacaagtcctcacaatcccaacaaatccttcgagatcgttcagcccccaaatgatagtatctcaagcctatctttcagtccaaaagctaactatttggtggctacatcctgggataatcaggttagatgctgggaggtccttcaaactggggctagcatgccaaaagcagcaatgtcacatgaccaaccggttctctgctcgacatggaaggatgatggcactgctgttttctctgctggctgtgataaacaagctaaaatgtggccactgctgactgggggtcagccagtgactgttgccatgcatgatgcacctattaaggacattgcatggattccagaaatgaacttgcttgcaactggaagctgggacaagacacttaagtattgggatacacgacagtcaaatccagtgcatacacagcaattaccagagcgttgttttgcattgagtgttcggcatcctcttatggttgttgggactgctgataggaatcttataatttttaatttgcagaatcctcaaactgaatttaagagaatttcatctcctctaaaataccaaacaagatgtgttgcagcatttccagacaagcaaggatttttggtgggttccatagaaggaagagttggagtgcatcatgtagaagaggcacaacagagtaagaacttcactttcaagtgtcacagggattctaatgacatatatgcagttaattcattgaacttccatccggttcatcaaacctttgctacagcaggatctgatggagcattcaatttctgggataaggacagtaagcagaggctgaaggcaatggcaaggtctaatcaacctattccttgcagcacatttaatagtgatggttctctatatgcttatgcggtgagctatgactggagtaagggtgcagagaatcataatccagccactgctaaacaccatattcttctccatgttccacaggaaagtgagattaaagggaaaccccgagttacaacaagcgggaggaaataaagtcacttatgtcttctgttgcaatgttgagtgccctattctcggtgcatggattttagctttattagttcaggaatttcatggagcccctgttgtttgtgtgatgtaactttttgatatatgatgtaatatacgatgttatattacaaggtattgatattcaatccaatttcatattcgggttcaatgtagtgcctctcattttagggtgatagcatgagtttttttttagtgttatgacatcgacatctacgtagagttgcatgaacaaaaaaaaaa

SEQ ID NO: 205 - DNA, 1721 bp, Pinus radiata
gataaatatatgacatttgctcttctgtcgagaacctgtggaccggggtagtagcatatacatatgtaggttgagagcgagaggatagcgaaatccttacctatagccaccacaagcagtggaagtagcactggcagtgaaactagaagcataagtagttacggaagaagcaccacaagcatcaaagctagaagcagagtactccgatttccatttttcctggaaagggccattgagtgtatggtcgtaatggataaggggacacatcagactaacgaggacgagagcgaatcagagttcatcgacgaggacgatgtgattgatgaaatttccatagatgaggaagatcttccagatgctgatgtggaaggcgaagatgtgcaagaagacaacaaaagaagtgagccagatgagaactcaagtagtttggacgatgctatacacactttcgaaggtcatgaagatactctgtttgctgtagcatgcagtccagttgatgcaacatgggttgcatcaggtggtggagatgacaaagcttttatgtggagaataggccatgcaacgccattttttgagctaaaagggcataccgattctgttgtagccttgtctttcagtaatgatgggcttttacttgcatctggtggtttggatggagtagttcgcatctgggatgcttctacgggaaatctcatacatgtactagatggtcctggaggggggattgagtgggtcagatggcatccaaaagggcatttagtcttggcaggatcagaggattacagtacttggatgtggaatgctgatcttggaaagtgcctttcagtatatactggtcattgcgaatctgtcacatgtggcgattttacaccggatggaaaggctatctgtactgggtctgcagatggttccttgcgggtatggaatccacagacacaagaaagtaaactcactgtaaaagggtatccataccacacagagggtctaacatgcttgagtattagttcagattccacattggttgttagtggctccacagatggcagtgttcacgtggttaacataaaaaatggaaaggtggttgcttccttagttggtcattctggatcaatagagtgtgtcaggttttctcctagcttgacttgggttgcaactggtgggatggataaaaaactaatgatttgggaattacaaagctcatcactgcgatgcacttgtcagcatgaggaaggcgtgatgaggttatcatggtcattgtcatcccagcacataataacttcttcccttgatggaattgtccgcctttgggatagtcggtcaggggtttgtgaaagagttttcgagggtcacaatgattcaattcaggatatggtggtgacagtggatcaacggtttatccttacaggatcagatgacacgactgcgaaagtttttgaaattggggcattttgattttatataatgtttcattcaaaattattgccatgtttgattctgagtcacagcagaagattagaggagctgagactgaggtaataaattgctttccacaagttaacataggtaactatcgactgaagtgaactggggggcagaagctaactatgttggtttctttttctgtaaggttcttttaacaataataatgttgtgtctacaatttttttgtaattatcttttagcagttgacattagtatttgagtaaactttaaaaaaaaaa

SEQ ID NO: 206 - DNA, 1369 bp, Pinus radiata
ccgacgtcattatagaaacccttcatttttaagtagttacagagtgatggctgctatcatatcgttgttcgcaaatcggggcacggttaggtacatgagcatcagttcattatcataatcgcacgcttccaaagttcatctctgattttcttcttcttacacaggaagcaaaatctgagataattgtaaagaccatacaagcttgaatttggatttgccacgatgcctgtatttaggactgcattcaacggctatgctgtcaagttcagtccatttgtggaaactcgtttggctgtggcaacggcccagaattttgggataattgggaatggtcggcagcatgtgctagaacttacacccaatgggatcgttgaggtctgtgcttttgattcatctgatgggctttatgattgtacatggtccgaagctaatgaaaatttagttgtttcagccagtggtgatggcagtgttaaaatttgggatatagcacttccacctgtagcaaatcctattcgaagcttggaagagcatgcacgtgaggtttactctgttgattggaatcttgttagaaaggattgttttttaagtgcgtcctgggatgatactatcagactttggacgattgacaggcctcagtccatgcgtttgttcaaagaacacacttattgtatatatgcagcagtttggaatccaagacatgcagatgttttcgcctctgcttcaggtgattgcactgtgaggatttgggatgtcagagaacccaatgcaaccatcataattccagctcatgaacatgagattctttcttgtgattggaacaagtataatgattgtatgctggtgacggggtctgtggataaactaattaaagtatgggatattaggacctacaggactccaatgacagttttggaaggacacacatatgcaatccggagagttaaattttcacctcaccaggaaagccttattgcatcatgttcctacgatatgacaacatgtatgtgggattatagagctccagaggatgctcttctagctcgatatgatcatcatactgagtttgctgtgggaattgatataagtgttcttgtggagggtctgttggcaagcactggatgggatgaaactgtctatgtttggcagcatggaatggatcctcgagcttgttgagactgggtgtactagcttggcctttccctctcagattactggtttggtcttttacttcctctccgaggatgcaggaactgttttgcatccattttagatagccatttacattttacttattattggacttgtaaagatttttgtacccttgtaaattgcaaatttaatttacatttcttttgcattaaaaaaaaaa

SEQ ID NO: 207 - DNA, 2499 bp, Pinus radiata
gatttaatgatcttcctcctccttctcatatcagctgatcaaaattcatcagaagaggagagaaaagagctatcggcattaaattttcagacaaagtcttgggatttagattcgactactcttcttctgatactagctgatccaaatctcagcagaaaaggagagaaaagagccgttggaattaattttttcagacgaagtccttgtgattctattttgcagagactgaacaacagtgttactcagtgcaatggattcccgaaacaggcgatcgcgcttgaatttgcctcctggaatgtctccgagctccttgcacttagaaacaacagcaggctctcctggcctctcgagagtaaattccagtcccagtaccccttcccccagtcgcacaacaacgtacagtgaccggttcattcccagcagaacagggtccaggctcaacggatttgcacttatcgacaaacagcctcagcctttgccttcgcccactcgctccgctgccgagggccgtgatgatgcatcttcatcctctgcctctgcatactccacattgctgagaaacgagctctttggggaagatgttgttggtccagccactcctgccactccggagaagtccactggactctatggcggttccagggattcgatcaagtcacctatgagtccaagcaggaatcttttcagatttaagaatgatcatggagggaacagtcccggttcgccttactctgcctctactgttgggagtgaggggcttttctcgtccaatgtcggaactccacccaagccggctcggaagattactcgttctccttacaaggttttggatgcccctgcacttcaagatgatttttacttgaatctcgtggattggtcatccaataatgtacttgcagtaggcttaggcacctgtgtctacctatggagtgcatgcaccagtaaggtgacaaaattgtgtgatctaggagtcaatgatagtgtctgttcagttggatggacaccacagggcacacatcttgctgtgggtactaatattggagaggtccagatctgggatacatctcgctgtaaaaaagttcggaccatgggtggtcactgcactagagcaggagcactagcttggagttcttacatcttatcatctggtagcagagaccggaatattcttcatcgtgatattcgtgttcaggatgacttcataagaaagcttgttgggcataagtcagaggtctgtggattgaagtggtcttatgatgatcgagagctggcatcgggtggaaatgataatcagctcctagtgtggaatcaacaatcggcacaacccttgttgagattcaatgagcatactgctgctgttaaggccattgcatggtcaccccatcaacatggaattcttgcatctggaggtgggacagcagaccggtgtcttcgcttctggaacacagcaacagatacacgtttgaattgtgtagacactggtagtcaggtttgtaatcttgtatggtgcaaaaatgtcaatgaactagttagcacgcatggatattctcagaaccagataatggtctggcgatatccatcaatgtcaaagctggctactctaacaggccatacacttagggttctctatcttgccatctcacctgatgggcagacgattgtcacaggtgcaggggatgaaacactgagattttggagtatttttccatctccaaagtcacagagcgccgttcatgattctggattatggtctctaggacgaactcatattcgatgatatttttattagaggaaacatatcttttccctcccatgagaaaatatttcttgtccaaatccattttatgctgctaggtaatccaactgggaaccataaatcataggaatccctgtgaggtgaaggcaggaataaattatgtcctgaacttatgtgtcttccaacaaaaaaccataaatcgaagcattatttgtaagatcccctgtgagttgaaggcaagagtaaattatgtcctgaaattattattctttgtaccaaaagttttcaatacagcttgaggttttactgtctgttaaatatgaagagcgaagccacaataggattttccctcatttttgtttggcaacatcaagtcacacaatctttcgagaatttaggcaagcttcatcaaagttgatttgtttgatagttgtgtattctttggtttccaaatattttttgggttttcttgtaggcagaagtgaggctggttggaaatgtgatctctttaaaggttgtttcttttcgatggttagctatgggttactgatttcagattgtaatagtttattgctgagtgaacatctgcatctcatttttcatgcttgtctttattcagctattctgctgcaattgctgaaatatttcaagctgaaagttatgattctggccaagaagtctactgaaaatttgtattgtggaaatatatatatacatcagagtcagttatttaaaaaaaaaaa

SEQ ID NO: 208 - DNA, 1915 bp, Pinus radiata
ggttttcagcccaaaccgtcaaataataaatccatcgatacatcatccatccatcctgattcggcttcggcttcgactcccttttgtacccttttcccacccggccattcattcacattttcacccgtttctacgcactgtctagccgccttttaatttccatttaattaaaaatccgctgcaaactctcagttccaggtatatctgtacgttggcatctcaagcgccgaaaattgtacagtttgaaagagggcagggaagcccttccctaaatagaaatttattctctggtagagaagtatagtttttggtgtgcatttttttcttcttttaattcttatttagaagagggtaaaaggtggcagtatggagaagaagaaggtggtggtgccaatcgtctgccatggacattcaaggcctattgtggatttgttttacagccccgtcacccccgacggcctcttccttatcagcgctagcaaagattctagtacaatgttgaggaatggtgaaacaggggactggatcgggacatttgaagggcataagggtgctgtgtggagttgttgtcttgataatcgtgctttacgtgcagcatcaggatcagctgattttagcgccaaaatatgggatgcgttgacaggagatgagttgcactgttttgtgcacaagcacattgttcgagcatgtgctttttctgagagcacaagccttttactcactggaggacatgagaaaatactccgtatttttgatttgaaccgtcctgatgcacctccaaaagaagttgataattctcctggttcaatcaggacggtagcatggcttcacagtgaccagactatattgagttctaattctgatgccggaggtgtgaggctgtgggatttgaggacagaaaagattgttcgtgttctggagacaaaatcaccagtcacaagtgctgaagtgagtcaagatggacggtacattacaactgctgatggcaatagtgtaaaattctgggatgctaaccactttggaatggtgaaaagctacacaatgccatgcatggtggagtctgcttcattagaaccgactatgggcaacatgtttgtggctggtggagaggatatgtgggttcgtctttttgattttcataccggagaagaaattgcttgtaacaagggacatcatggcccggttcattgtgtgcgttttgctcctggtggtgaatcatattcatctggatctgaagatggaacaatcagaatatggcagaccttgaatatgaattctgaagagaatgaaagttatggtgtaaatggattgagtggcaaggtcagagtgggtgttgatgatgtggtacagaaggttgaaggattccaaattacagcagatggccacttgaatgacaaaccagagaagccaaatccataataatgcagtagtgtatatccattgctgggaagccattgatctgtttgttgaagtttgcttgcctgaggtgtacaattttttgtcgctgatcaagtggcaaatcaaactgcacacaggatcctgcttactgtacatagtagattatgaggtcatatcacgtggttcttttacatctgcaggtggtgctcctttttttcaagctcctggagattggtatggttgaaggatggcagtaagggtccagtattaattagattaccttaatgattcagttctttatgttatcactgtcttgacttttggattagatgtttaactaggaaggtagtaaggtaactaaaatgaatgttgtaaaaaaaaggaagaaaatgaaaaaacataagtttggcccagattcggtttatcataaaatctggctgcatataaggtgtcagttcaaacacaggcaggtcagaataaataaattttatttatatagtttttgttaaaaaaaaaa

SEQ ID NO: 209 - DNA, 1446 bp, Pinus radiata
ctaagggatacattaaaggctactaatcgccgacagcattgaccagatagactctaaaacattccttcattttgttctgcttcgtaaaccaccgtccatgactccagggatttatggcacagacgtgttggtggctatgcaaaatttttagtccggtatgtactgtggtcggattgaggaagaatttctggatatttagggtttatgaattcgtgaagcagagcgaatcaacataaccaggcgactggtatttagaataatataaaacaagggtagtgtttcaatggaaaggtattcccaaggcacacagaaaaaatcagaaatctacacatatgaagctccctggcaaatatatggcatgaactggtctgtgaggaaagataagaaatttcgtcttgggattggtagcttcctggaggagtataacaatagagtagaaatcattgagctggatgaggaatctggggaattcaagagtgatccaaggcttgcttttgaccatccatatcccactaccaagataatgtttgttcctgataaagaatgccagaggcctgaccttctggccactactggcgactatctgagaatctggcaagtttgcgaggaccgagtagagcccaaaagcctcctcaataataataagaacagtgaattctgtgcacccttgacttcttttgactggaatgatgccgatcccaagcgaattgggacatcgagcatcgataccacttgtactatctgggacatagaaaaggaagtggtggatacacagctgattgcccatgataaggaggtctatgatattgcctggggggaggtaggggtttttgcttctgtatctgcagatgggtctgtgagagtgtttgacttgagggataaggagcattctactattatatatgagagctcacagccggagaccccattgcttcgattaggttggaacaagcaagatccgaggtttattgctactattttgatggatagttgtaaggtggttatcttggatattaggtttccaaccttgcctgttgcagagctccagaggcatcaggctagtgtgaatactattgcatgggctcctcacagcccttgccatatttgcactgcaggagatgattctcaggcactcatatgggaattatcctccgttagtcaaccactggtggagggtggtggtctagatccaatactagcttacaccgcagctgctgaaattaatcaattgcagtggtcttccatgcagcctgactgggttgcaattgcgttttctaacgaagtacagatactaagggtttgaaatttattgctttgtagtttttcattcaaatgttctagaatttgtctaagctagctactggtgtttaactgatatggaaaacttttgccattctcttatctggatagttccataatggtaaagtacattatgcaaaaaaaaaa

SEQ ID NO: 210 - DNA, 2181 bp, Pinus radiata
ccaaaccaactttcttcttttctttgttctctacctgttgaagaggatgacccaggcactgtcaattgaacggattttgggctttgtgaaatcagaactcaagtctgctcgtccaacaagtacgatataaaagggttgttctattcaattagattccagtattggccagaccatctactctctttcacctaccttttgttcccatgaacatccctctttctcatctccattctcatcatttagtctgaaaacttcattttcatcacacccacatgctaatttacttttttggaccatacccacttcatcttctgtcctatgtcatttaagacgtcactcaaatgtctttcaagagcataccggcatattatatccgtccttctataaggtctctggtttgattatttcttggagatgtcgtatatctggtttctagctagaggagtttagggttcccctgtaactctctaggtactcgctttctgtaggtgggtttgaggtctacacatatttcaatcattgcggattctcctgcttaagattttgatcataataattttggtgccaaacactctcaagatcagtttaccgtggcgttcataataaaagcctattagttcacctcttccgtccaagggataagacaaaccctaatcatatcgggtgtcggctcatccggaagtatgcaatcggaaaataatttggatgagtctttgcacctaagggaggttcaagagttgcaggggcatactgacactgtgtgggcggtggcatggaatcctgtcactggaattgatggagctccatctatgctggcctcttgcagtggtgacaagactgttaggatttgggagaatacacacaccctcaattcaacatctccctcgtgggcgtgtaaggctgttctggaagaaacacatacaagaactgttagatcatgtgcatggtcacctaatgggaagttacttgcaacagcaagttttgatgcaactactgcaatctgggaaaatgttggtggtgaatttgaatgcattgcctccttagagggccatgagaatgaagtcaaaagtgtttcttggagcgcgtctggtatgctacttgccacatgtggtcgtgataagtctgtctggatttgggacgttcaaccggggaatgagtttgagtgtgtttcagtactgcaaggccatacacaggatgtcaagatggtccagtggcaccctaatcgtgacattttggtctctgctagttatgataattctatcaaggtttgggcagaggatggagatggtgatgactgggcatgcatgcaaacattgggcaattctgtcagtggtcatacatcaacagtgtgggcagtatctttcaattcttccggagacagaatggtctcctgcagcgacgacttaacgttgatggtttgggatacaagcataaacccagcggagagaagtggaaatgctgggccctggaaacatctttgcaccatttctggatatcatgatcgaacaatattctcagttcactggtcaaggagcggtcttattgctagtggagcgtccgatgattgtatcaggctctttagtgagagcactgatgattctgtgacaccggttgatggcacatcgtataagttgattttaaaaaaggaaaaggctcactcaatggatgtgaattcagtccaatggcatccctcagagcctcagctactggcttcagcaagtgatgatggtcgtattaagatatgggaagttactcggataaatggactagcaaacagccattgacatagtatcattccacatgacatctaaaggatgggagattggtatatcttacctgcaggggaagcaaatttctttattgtagcttcttgttgactctcagcttctctgtgggtttgcttttggggagtactttagtcaataaaagtgaagtgaatcatgatataaagggtttaagtaaagagttgagaataagcagattttagtgaaatacaactggtatggcatttattgtggctgattttccctgtatggcctctgaagcagatttcatgactaaattttcattaggggtttctgtagtttaacataaatcaacatcaagtctgatttggaatttttgttttgttcgttaaaattaatttgatttctctggtattgtaaaaaaaaaaaaaaaaaa

SEQ ID NO: 211 - DNA, 3279 bp, Pinus radiata
ttttttttttgaactagccacgacacagaaatcttccgcttcgtgtacgtcataaagcggttcggaaggccgaaccagacgcagatgcagagtggaaggcgattccaggattgattcaagtcacagagaagaaaaccgaggagcaggcgaggcaggtttttttgaatggtaatgggcggtttttgatgtcagatttggtgctgtgaaaacataagagccggcattgtgcatttcatagtttttggtggtggggattggactgagaagagttatgcgaaaccagcgatatagaagtccaacactgatttcagagcttttctccggtcaccaaaaccatgaagcgggcttacaaattgcaggagtttgttgcgcatgcttccaatgtcaactgtctcaagattgggaagaagtcttccagagttctggtgacgggcggggaagaccacaaagtgaatatgtgggctattggaaaaccgaatgccattctgagtttatctggtcattcaagtgctgtggagtctgtgacttttgattctgcagaagctttagttgtcgctggagctgctagtggtacaataaagctatgggatttggaagaagcaaaaattgttcggacactcactggtcataggtccaattgtatatcagtggatttccatccatttggggaatttttcgcatctggctccttggatacaaacctaaaaatctgggatattagacgtaagggttgcattcacacttacaaggggcacactcgtggtgttaattcaatcagatttagtccagatggtcgttgggtggtgtcaggtggggaggacaatattgtaaagttatgggatctaactgctggaaagctcatgcacgacttcaaatgccatgagggtcagatacagtgcatggatttccatcctcaagagtttcttcttgctacaggctcagcagacaggactgtgaaattctgggaccttgagacttttgagcttattggatcagctggtcctgagacaactggagttcgtgccatgattttcaatccggatggaaggactctgttaactggattgcatgaaagtttgaaggtgttttcctgggaacctttgagatgctatgatgcagtcgatgttggttggtctaaattggctgacctcaacatacacgaaggaaagcttcttggttgttcatacaatcaaagttgtgttggtgtatgggttgtggacatttcgcgggtggggccatatgctgctggaaatgtatcaagaacaaatggccataatgaagcaaaattggcttccagtggtcatccatctgtccagcaattagataataacttaaagaccaatatggcgaggctttccttgtcacacagtacagagtcaggaatcaaggaaccaaagactaccacatcgttaactaccactgaaggtctttctagcacacctcaacgagctggaatagccttttcttcaaagaatcttcctgcaagttcaggtccaccgtcatatgtctcgactccaaagaaaaatagtacatcaagagtgcagcctacaacaaattttcaaaccttaagtagacctgatatagtgcctgtcattgtccctagaagcaattcattaagaccggaaacaacatcagatgttaagaaagaaatgaacaattttggaagagtggttccatctacagtatcaaccaaatcaactgatgtgattaaatctggcagcaacagagatgaatctgacaagatagactccataaatcagaagcgcatgacaggcaatgacaaaacagacctaaacattgctagggctgagcaacacgtttcctctagacttgacaatacaaacactagttctgttgtttgtgatggaaatcaaccagcggcaagatggattggtgcagccaaattcagaagaaattcaccagtagatccagttgtaagcccacatgatagaagtcctacttttccatggtctgcaactgatgatggagttacatgtcagccagatcgacaagttactgcacctgaattatcaaaaagagtggtagagcctggtcgtgctcgtgctctggttgcaagttgggaaacacgagagaaggctctcaccgcagacacacctgtgctggtcagtggtcgcccccccacaagtcctggagtggacatgaactcattcatcccgagaggaagccatgggacttcggaaagtgacttgacagttagtgatgacaacagtgctatagaagagctcatgcaacagcacaatgcatttacaagcattcttcaagctcgcttgactaagttgcaggtaataaggagattttggcaaaggaatgacttgaaaggtgctattgatgctacgggaaagatgggagatcattcggtatctgctgacgttattagcgtactgattgagagaagtgaaatcttcacgctggatatttgcacagtcatacttccattgcttactcggttgcttcagagcgagactgacaggcaccttactgtcgctatggaaaccctgcttgtgctagtgaagacttttggtgatgttatccgggcaactatatcagcaaccccaacaattggagttgatctccaagcagagcaaaggcttgaacgctgtaatctgtgttatgttgaactggaaaacatcaaacagattcttgttcctttaatcaggagaggtggagctgttgccaagtctgcacaagagttgagtttagctcttcaagaagtgtgacccactctatttaggttgacattttttttttgtaataaatcttctttgacgggaggctgtttgtatattgggaaacactgcattgtttgcaatgatagtggcagtgtggttgaatatgcacggcatcaattgcagtggaattcttatctcaggtcattggagtgtttaaccattcctatgttgtcagccacatcttgtcagccacaccttgattcttagattaagaagttactaatttgtagataaattctaacgaaggtgatgatagcatacacgtaatgaaatcacagagaatgtctacgcagttgacactgcaactagtcttgcgtgaacctgtagttgcggcatgcttcaacctttgttgtaatatttaaaatatttgagtggcttaagcactcaatttcctgtttgatcaagtcagttgctagattcttcagttgcttttctccgttcatacaatcagcaattggatattgatgaatttcattacagagtttgataatctgtgagccatcatatattaattgtacattcataagca

SEQ ID NO: 212 - DNA, 1866 bp, Pinus radiata
gttgattctgaactgaaggtatacaaaggcgaagaataacaaagtaggagcgccgtcggtgctccgtcaagccggcggtcatgtccactctcgaaatcgaagctcgcgatgttataaaaattgtgctacaattttgcaaagagaattctttgcaccaaacatttcaaacactgcaaaacgaatgccaggtttctcttaatactgtggacagccttgaaacatttgtagcagatatcaatagcggaagatgggatgtgatactgccacaagttgcacagcttaagcttcctagaaagaagctagaagacttgtatgaacagattgtattggagatgattgaactccgagaattagatactgcaagagctattctaaggcagactcaagcaatgggtttcatgaagcaggagcaacctgagcgctatctacgcctggaacaccttctagttcgaacatattttgatcctcgtgaggcttatcacgagtcatcaaaagagaagaggcggtcacaaatagctcaagctttggcatccgaagtaactgttgtgccgccttctcgattaatggccttgattggtcaatctttaaagtggcaacaacatcaaggattactccctccaggtacacagtttgacctcttcaggggcactgcagcagtgaaggcagatgaggaagaaatgtatccaacaacactggcacatacaattaaatttggtaaacaaagccacccagaatgtgctcgcttctctccagatggtcaataccttgtctcttgctcagttgatggattcatagaggtctgggactacatcagtgggaaacttaagaaggatcttcagtatcaagctgatgattcctttatgatgcatgatgatgctgtcctctgtgttgacttcagtcgagattcagagatgctggcttctggttcacaggatgggaaaattaaggtatggcgtatacgaacaggtcagtgtttaaggcgtctagagcgtgcacattctcagggtgttacaagcctttccttctctcgtgatggcagtcagcttttaagcacatcatttgacagtactgcaagaatacatgggctcaaatctgggaaagcattaaaggaatttcgtggtcatacatcttatgtaaatgatgcaatattcacaagtgatgggggtcgtgttattactgcttctagcgattgtactgtaaaggtttgggatgtgaagacaactgattgtattcaaacatttaaacctccacctcctctcaagggaggtgatgtatcagtgaattctgtccacctttttccaaagaactcagagcacattgtagtctgcaacaaggcatcatcaatctatatcatgacactccaagggcaggttgtcaaaagtttctcatctggtaaaagggaaggaggagattttgttgctgcatgcatttctccaaaaggagagtggatctattgcgttggggaagacagaaatatctactgcttcagtcaacagtctgggaagcttgaacatcttatgaaggcacatgacaaggacataattggtgtaacacctcatccacataggaatttgttggtaacatatagtgaagatagcacaatgaagatatggaaaccctaatatggattttatactgctattggatttgtatagaaataatatttttttgaattttgatggtagcgtatggttgaaggaaaacttggatatatcatgtaaacatttttcccccataaaggaatgtatattttttttatttactgcactttatatttctctgaccctctctcacacacatgcattggcactacacaattacacagaaatataagcactctgcttttacatatgtttaaaaaaaaaa

SEQ ID NO: 213 - DNA, 1820 bp, Pinus radiata
gcaacatagtactcgatgccgtcgttttggttccacactgaccaacgagctaagattgaagttccgaagtacgattcttatttcacatattcttgccgtcttcaggttcagctcgcaaagggtaccgaggagctcccagatgcagaattggagaacacttatctatctatccgactaacagagaagtggtatctctcgctctaagcttccatcctgaattatctccgtttcggctctcccaccgaactagcgctacgggcttgtattttagtaagtaataccgaaaagcggcggaaagggttttgaatacgtagagaagaggaagggagggatagagacagaggtgctcgcaccaggaagggagggatagagacagggagggatagagacagatacagatggatattgaactggaggatcaaccctttgatttggatttccatccttctgctcctattgttgcagtggcacttattacaggccgcctccagttgtttcgttatgtagacatttcatcagagcccgaaagattatggactgtgactgctcatactgagtcctgtcgagctgctcgatttattaatgctggtagttctgtgttaacggcgtctccagactgctcaattcttgccacaaatgttgaaactggacagccagtagccagacttgacaatgctcacggggctgcaataaattgcttaaccaatttaacagagtcaactattgcatctggagatgagaatggaatcattaaggtttgggatacacgacagaattcctgttgcaacaagtttaaggctcatgaagactatatttcggatatggagtttgttcctgatactatgcagctacttggaacaagtggtgatgggaccctttctgtttgcaatcttcgtaaaaataaggtccatgcccgatctgaattttcagaagatgaactgctttcagtggccttgatgaagaatgggaagaaggtagtatgtggttcacaggaaggagttctgttgctttattcatggggttattttaaggactgcagcgaccgctttgttggacatccacactcagttgatgctttgctaaagttagacgaagacacagtgttaactggatcaagtgatggaatcatcagggttgtctccattcttcccaacaaaatgattggtgttataggagagcacagcagttatcctattgagcgccttgcattttcacatgatcggaatgttcttggcagtgcttcacatgatcagatcctaaagctctgggacatacattatcttcatgaagatgatgagcctgaaactaacaagcaagaagctgtgaatgacgaaaacgtagacatggatttggatgttgatactgaaaaaagaccaagaggatccaaacgaaagaagagagcagagaagggccaaacttcatctcaaaagcaatcatctgatttttttgcggatatataacattgacagtgttcaagcttatgtattcctattatttaaaatttttattctcacgggtgacctgatttctaaaacattgatcccttgttttcaattatatgtttgtaatatgtaatattttaacgatatcttcctcccaattttgcaatagtgagagtgggtattcctttatatatacaggggccaaatgcttttgcaaatgcccttctgatccatcgattctaaatgtatgaatttttcccaccgtatactttttaatgaaccgctttttccttgagaggctatgaatgcctgtagaactaatcctttaagtaattgtatatattgaatgagcagtatattttctttttaaaaaaaaaa

SEQ ID NO: 214 - DNA, 2273 bp, Pinus radiata
gcgatacgtagggtcatggcaactaatgaaatctacaggaaaagccaccagaaaaccacgtcccttcgccactaaaactcccatgaaaacaataaacgcagaattcccattactcataaaaacccaacacacatcaccaagaaatttgtatcagggacgcaattccgaagggctccaggggtttcagggccggatcctctctaaatatggataggatccagcaaatcccccacacctgcgtagctcgaaagattaatttgcccctgggaatgtccaaagagtctctagctctgaacctccctgctaatttggcgcccactatgtctccgccgagtattacttacagcgacaggttcatccccagcaggaaggcctccaatttcgaggaattcgcactgccggataaaacgtcgccttcgccgaattcggctgggggtcagtcctcgtccaccaatggcgaagggcgcgatgatgcctgtgcggcttattcggctctgctgaggaccgagctctttccagctacccccgataagaccgagggttgcaggaggcccgtgattgggagccccagtggtaatgtgttcaggttcaagtcccagcagtgtaaatcccagagccctttttctttatgtcctgttggggaagatggggatcttagcgaaacaggggcggttgccaggaagactacgagaaaaatccctcgttcccctttcaaggtcttggatgctcctgctcttcaagatgatttttatctaaatcttgtggattggtcatctcataacatacttgcagtggggttaagtgcatgtgtttacctgtggagcgctagtagtagtaaggtgacaaaactatgcgatttaggtttggacgacaatgtctgttctgttgcgtggactcagcgggggacatatcttgctgttggaacaaacaatggtggtgttcagatttgggatgcggctcattgtaagcaggttcggaccatggaaggtcattgtaccagagtagggactttagcttggaattctcacatattgtcatctggtggtagagatagaaacattcttcagcgtgacattcgagctcaagatgactttgtcagtaaattttctggccacaagtcagaggtttgtgggctgaagtggtcctatgacaaccgggaacttgcatcgggtggaaatgataaccagctttttgtatggaaccaacaatctcaacaaccagtgctgaaatataatgagcacacagctgctgtaaaggccattgcctggtctccccatcagcatggtcttcttgcttctggaggtggaacagcagatcgctgcattcgtttctggaacacagcaaccaatacttccttaaattgtgtggatactggtagtcaggtttgtaaccttgtatggtctaagaatgtcaatgagcttgtgagcacccatggttattctcagaaccaaattattgtgtggcgatacccaactatgtcgaaacttgcgactctaacaggccacaccctcagagtgctttatcttgcaatttctcctgatgggcagactattgtaacgggtgcaggtgatgaaacattgcgcttttggaatgtttttccatcttccaaaacacagcagaacactattcgtgacatgggagtttggtcttcgggtcgaactcatattaggtaacatcaaaacttcctcttcttagaggaagatgtgaagtggcattgagcagttgttggggaatttggtgggaaaccccatacaagttgactgtattaagtctcagctgaacaaggatctggcgtgagcagaagttgtcaacaggttatctacctgttgtagcttttaagtagtgctttcttaagagacaaccagttgaggcagtggaacaaactacaggctgtgcagatgcttccccttgcctggctggacaaatgtattggtaaaaatgctagatcatcttagaaaataggcacgcttagtcaaactcatccttggtggggatgactttttcaaaggtttgaaagtgtcttgtatctttgttaggttcaatgaattaattattttctctaacactatattttctggtatgaccgctctacattgtatattaacccttgcaaatgagatcacatttgcagtccaaacaatatcctctgtccataaggttgtacttgtacttgaacatactttttgtagaacatactaccaagagaaatattcagcaaatatcatttgagagttttccctgcaagtttggggatttctcaatcaaaaaaaaaa

SEQ ID NO: 215 - DNA, 1576 bp, Pinus radiata
aatacggcatacacttacgagcatatagccattctcgcttcccggggtgttggggctatatcaaattctcaagcgcaattgactggctttcaaaatcatgaatttgacgtttccctatcgcgattggagtcgctgaaatcttctggctctttgaatacccttagacattagacgtttaatacacatcgtgaaaggatcctagccactttaagaattcgcagggttccaaggagttctggatattcaaccgtgccaataaaaaatggcaggaggccaaggtgaaggggaggagaaagtagataaattatcgatggaactcacagaagatgtcatgaaaagcatggagattggtgctgtctttaaagattataatgggaaaatcaattcgttggattttcacagaacgaacaattatttggttacggctagtgatgatgaggctattcggcttttcgacactgcaagtgcaacatggcaaaagaccagttatagtaaaaagtatggtgttgacttgatttgcttcaccaaccatcaaacatcagtactgtactcttcgaaaaatggctgggatgaatcattgcggcatctttccctcatggacaataaatatttgcgttatttcaaaggtcaccatgatagggtggtttccctttgtatgtcaccaaagggtgagtgcttcatgtcaggttccttggatcgcactgtgcttctttgggatctacgaattgataagtgtcagggtttgatacgagtacgaggacgacctgctgtggcatatgatgaacaagggcttgtctttgctatttccaatgaagggggtttaataaaaatgtttgatgctcgcttatatgataagggaccatttgatacctttgttgtggaaggagacaaatccgaggcatcagggataaaatttagcaatgatgggaagctaattcttttgtctaccatggacagcaacatacatgtcttggatgcatatcaagggacaacggtgcatagtttcagtgtggaagctgttcccaacggtggtgaagctgttcccaatggtggaactctggaggcatctttcagcccagatggcaaatttgtgatttcaggttcagggaatggtaatatccatgcttggagtgtcaactctggcaaagaagttgcttgttggacgactgaaggagtcattcctgcagttgtaaaatgggccccaagacgcttaatgtttgctagtggatcatctgtgctgtcattatgggtaccagatttatcaaagttggcttctcttactggttcaaattctaatagtgcttattgatgacattcagtggagcccaagagagacagatctgacattcctccagtgaccctaggatgacaacagctcttaatttctttcttggatatatatttttccttacatctagtgtcttctgtcttctctgccttttgtaattttatattcactgtgctgggattatcctctcccctttttgacccactgttgtgtgtatttgaatttgtacgtataattttttttgtttttgttgtttaatataattagctcttaatcacaaaaaaaaaa

SEQ ID NO: 216 - DNA, 3098 bp, Pinus radiata
gcgaggaagaagaagcgtcgagggtttagtcaaaatcccaaaaccttgatccaatagatgctcatatgcacccagattgtacccccggaattcgaaacccgctgacgcagatgtatatttgggaaaaattggccttggggatgctgatctgctcgagccttgaaagacttctgtgaggatcttcattatcggaaatcacccgaggactgctggagatcaggtgtttctgcaatgcaccgtgtgggcagtacagggaatacttcaaattcgtcccgtcctagaagagaaaagcggttaacttatgtgttaaatgatgcaaatgattccagacattgttcagggataaactgcttggtgatatcaaagttatctttgcttggtggaaatgactatttgttcagtggtagtcgagatggaacactcaaacgatgggagttggctgatgattctgctgtctgcagtgcaacatttgaatctcatgttgactgggtaaatgatgcggtcctcacaggcgagacacttgtttcttgttcttcagacactactctcaagacctggcgtcctttctctgatggtgtctgcaccagaactcttcgtcaacattctgattatgttacatgccttgcagcggcatcaaaaaatagcaatattgttgcttcaggaggtcttggtcgtgaagtgttcatatgggatattgaagcagcaatggctccagtctcacggactagtgaagcaatggatgatgatacttcgaatggagttttgagttctgggaattctgttctatctacaactgttcgttctactaatgccaccaacagtgcttctttacacacttcacaattacaaggctacactccaattgcggccaaaggccacaaagaatcagtttatgcattggctatgaacgatgttggtaccttactcgtatctggaggaactgagaaggtagtgagggtgtgggatccaagaagtggggcaaagcaaatgaagctgcgggggcatactgacaatgtgcgagcactcattttggattctactggcaggttctgtttatctgggtcttctgattctatcatacggctctgggatcttggtcagcagcgctgtgtacattcatatgctgtgcatacagactctgtttgggcacttgcaagtacgccaaattttagtcatgtatacagtggtgggagagatctttctttatacctgacagatttgactacgagagagagtttactgctttgtatggagaagcatcctcttctacggttgacattgcaggatgactcaatatgggttgctacaacagattcttctttacatagatggccagcagaaggacaaaatccgccaaagatgtttcaaaggggtgggtctttcctggctggaaacctatcctttaccagggcaagggcttgtttggaaggatcagcgcctgtacctgtgaacacacaaccttcatttgttataccaggttctccaggaattgtacaacatgaaatactgaacaacaggcggcatgtcttgacgaaggatgctgaaggtactgtaaagctatgggaaattactcggggagcagtgcttgacgactatggaaaggtttcctttgaagaaaagaaagaggaattatttgaaatggtcagtattcctgcctggttcacaatggataccagacttggaagcatgtctgtgcatttagatacaccccaatgctttactgctgaaatgtatgcagttgacttaaatgttccagatgcaccagaggaacagaagataaatcttgcacaggagactctccgtggacttttggcacattggttgtcgaggagacgacaacggttggcaactcaagcttctgctaatggggattttccagcagggcaagaaaatgctctcaggaatcatatttcatccagaatagatgtccatgatgatgccgaaacccatattgctggaattcttccagcattcgatttctcaactacgtcaccaccatcaataattaccgaaggttctcaaggaggcccatggcgtaaaaagataacagatttagatggaacagaggatgaaaaggatttcccatggtggtgtctagaatgtgtactgcacggccgactttcccctagagaaagtttaaagtgtagcttttatttgcatccatacgagggaacaactgtgcaagtgcttacccagggaaaactcagtgcacccagaatattgcgcatacagaaagttataaattatgttttagagaaaatggtccttgatagaccactggattctagcaactcagaaacaacttttactccaggattaagtggaaaccaatcacatgcagcagtagttggagatggttctcttagatctggtgcacgagtctggcagcagaaagcaaagccattggtggaaattctttgtaacaatcaggtgctctcacctgatatgagtttggcaacggtgcgaacatatatctggaagaaaccggatgacttgtatctctactacagactagtgcaaaatagatgaatcttcgcacatccttttgagatgtgtttaaccttgtaataaagtagtctgatacaatgttttgcttgctttctgaattgtgtctttttcagatggcaatcttcataacttgttttcttcatcatatgcaaaatctgttggataattaagaggaacaaaatgaaaggtgtagtattcatgtattcatttctggtattgatactttttctaagtggtgccatgaggaggtacctctttttcattgtgtagactaaccatggaaaaaaacagaagagttcacatgtaaaggctgcctctaacaaggtgtggaataaaatttgtctccaagcaaggagaaaattcgagggttatcctcattcctgagagcatacagcgttatctttgagacgagtcatcaatgataatatcctcgtaaaaggttacaggatctgttgaagagagtgaattgattatcactgcatgtaaaacatctgtccacagaatgttcttgtgttttaatgtaaaattgggcacttctaagtgttctaaaagtagctcatatattgattttgatgtaagcaaaaaaaaaa

SEQ ID NO: 217 - DNA, 3115 bp, Pinus radiata
ccgcaactgtcactgatcgaagaaaagaagcagcagcagcaggagagcaagatcaatgatgaagggcaaaacaatccagatgcaagctgcccatcaaaatcatgatggcgaaacatcagtagcttgcgttctatgggattggcatgccaagcatctcatcactgcaggagccgataataccattctcatccattcttatccttcatcctcatcctctaaacccatcactcttcgccatcacaagaatgcagtcactgccctcgccataaattccaatgtgagaagtcttgcctctggatccgtcgatcactctgttaagctctactcttatccagggggtgaatttcagagcaatgtaacacggtttactctgccaatacgatctctggccttcaacaagtctggtgagttactagctgctgcaggtgacgatgaaggcattaagctaattagcaccatagataattccattgcaagggtgctgaagggccacaatggccccgttactagtatttctttcgatccgaaaaacgagttcttggcatcttcagacagtgatggcactgtcatatattgggagctttcaactgggaaacctgtacatacattgaaaaagattgcacccaatacgacctccaatccgacgagtttaaatcaaatcagctggcgtcctgatggtgagatgctggctgtcccaggcaggaagagtgaggtttcaatgtatgacagggatactgcagagaagcttttcagccttaaaggcgggcattcagatactatttgttctctggcctggtcgcctaatgggaagtatattgccacagctgggactgatcggcaggtcatggtttgggatgccgataggaggcaggatattgataagcaacgttttgacaacccaatttgttcagttgcctggaagcccagtgacaatgccttggcggtgattgatgtactgggcagatttggggtatgggaatcacctattgcatctcatatgaagtcccctgcagacggtgcagagcgctacgataacatggaagatgaagagcccttgatggctagatatgaagaggaattggaagatagtgtatctggaagcctgaatgagataataaatgacgacgatgacgatgatgaaatgggtaagattccaaggaagatcttacagaagaagccttctgttaaagttgaaaaaggcaaagaagagagcaacgctaaggcttttaagagtggtcaagactccttcaaattaaaatcagcaatgcaagaggcgtttcagcctggtgcaacgcagcggcaatctggaaagcggaattttcttgcttataacatgcttggaagtgttatcacctttgataatgatggcttttctcatattgaggttgacttccatgatatagggaaaggttgtcgtgtgccctccatgactgactattttggtttcaccatggcctccctcagtgaaagtgggagcgtttttgggagtccgcagaagggcgagaagaatcctagtacactcatgtatcgacctttcagtagttgggcgaacaatagtgagtggtccatgcgatttccaatgggagaggaggtgaaagctgttgctcttggttcaggttgggttgcagcagtgacaagtcttaatttccttcgggttttttcagagggcggcttgcagaaatttgttctttctatggatgggccagtagtcactgcagcaggatatgagaacctccttgttgttgtatcacatgcttcaaatcctcttttatctggagatcaggtgctcagcttcactgtgtatgacatttctcaaaaaacttgccctctctctggtcggcttcctttaagccctggctctcatctcacatggcttggattcagtgaagaaggcttattaagttcatatgattctgagggaaatttaagagtgttcaccaatgactacaatggctgctgggtgccaattttcagtgctgcaagagagagaaagtcagagactgaaagtatctggatggtggggctaaacagtacacaggttttttgtgttgtgtgcaaattgcccgatacctatccacaggtagccccaaagccagtcttgagtgtcctgaacttgtcattacctctagcatgttctgatcttggagcagatgacctagaaaatgaataccttagaggcagcttacttctttcacagatgcaaaagaaagctgaagatgcagtggcatgtggtcgtgaaagtaacatggaagaggatagcatttttaaaatggaagctgcacttgatcgatgccttttacgtcttatagcaaattgttgcaagggagataaattggttagagcaacagagctggcaagactattatcattggaaaagtctttacagggtgccataaaacttgtcagtgctatgaagctcccaatgcttgcagaacggtttaatactatactggaggagaagatacttcaggaaaatatggagacgatctcttgtaggagattaacttcggaggcacaagacatggacactccaatttccattagtgtcaaacaagtttcatacggggcaaaccttggtgatagcccctttcttccaaatcgtcaagtcgaaccaaagcattccactccagtgttttcaaagcctgatacaaaaattgaagtagatacctcagaagctatagcaaagggctgtgatgcacaaaatggaaatataaagagtggtgatgcagaggtccagcctgcaagccacaatgactctattcagaagccaagtaacccctttgctaaggcatccaatacttctgcaaaccaagctgtacagcgcaatgcatctttactgagttccatcaagcaaatgaagactgccacagaaaatgaagggaagcgaaaagaaagggcaaggtcaggttccttgccacagaaaccagcaaaacaaagtaagatttcatgataaaagcatgtgctcaatagtggaaacataagatacagtcaggctgaaaaccctgacaagtaaatgctctatgccatgtaggtgacatggatgtctgataatgatgactaagtgcctcatttattcaattacgacggattcagttggccttttgtaaaaaaaaaa

SEQ ID NO: 218 - DNA, 3086 bp, Pinus radiata
aaatacctagtatacataacaagatattatactctgttcctcgccctagattgcgattgaaagcaagcgagacagtcggggggcggggttgctgctgttgaaggcgccttgggctgtatagtaacaacacagccactgaaatcattgctggggcgtcggtaaagttgcagaagcagcaggacgactaacaggatgaagcagaagcgaaagggccatcaagttgatgacccaaaatattctgtccaaaccccccaagaggacgacacacctaacgaaagcggccctgcttcggaagaagtggagagtagtgacgaagaaggcggcaatagcagcaacatcgaagatgatattatttattcttcttccgaagaagaccccgttgttagttctgattacgaagaagacgaagacgcagaaagtgatgcagagggtgtgactgcagagcaagagttggaaggggacatcgacaatgccctccaaaattatatgggaacccttactgttctttccaattttcatggagagaaccttaaaaatgccgaaggtgaagatacttctggggatgatgatgacgaggaggagatgcctaaaagagctgaagagtctgattctccggaggacgagaatgatgagaggcctaaaagagctgaagaatctgatttttcggaggacgaggatgaggagaggcctaaaagagctgaagagtctgattcttcggaggacgaggttccttccagaaacactgttggagatgttcccctccgttggtataaagacgaacaacacattggctatgatattaagggtaagaagatcaagaagcagcctaaaaaggaccagctagattcattcctcgctagtacagatgattccagtgactggcgtaaggtatatgacgaatataatgatgaagaggttgagctaacaaaggatgaaatcaagtttattagtagattacgtaaaggcacaatacctcatgctgatgtcaatccatatgagccttatgttgattggtttgactggaaagataagggtcatcccttgtctaatgccccagaaccaaagcggagatttatcccatcaaaatgggaagctaaaaaggttgtgaagcttgtgagagcaattcggaaaggatggataacgtttcagaaagctgaagaaaagcctcgcttctatttgatgtggggagatgatctcaaaccatcagaaaaaatggcaaatgggctgagttatatcccggcgccaaaaccaaagttacctgggcatgaagaatcatacaatcctccacctgagtatattccaacacaggaggagatcaattcataccagcttatgtatgaggaagaccgtcctaaattcatccctaaaaggttcgactcattgagaaatgttccagcttatgacagattcctttccgagatatttgagcgatgtttagacctatacttgtgtccaagaactcggaaaaagcgtattaacattgaccccgaatcattgatacctaagcttccgaagcctaaagatctgcagccttttccctctatttgcttccttgaatataaaggccatacaggcgctgtttcatgtatatctccagagtcatcagggcagtggctggcctctggttcaaaagatggtactgtgcgtatttgggaggtggaaactgcgcgttgtcttaaagtttgggatattgggaggcccatacagcatattgcatggaatccagtttctcagctttctattctggcagttgcagtggatgaggaagtgcttgtactaaatactggacttggaagtgaggatagtcaagaaaaagttgctgaactattgcatgtgaaatcaaaacctgtatcagctgatgacttgggtgataacacttctctgactaagtggattaaacacgaaaagtttgatgggatcaaacttacccatttgaagccggtgcacttgatatcttggcatcataaaggagactactttgcgactgttgcacccgatggtaatactagggcagtacttgtgcaccagctttctaagcagcaaacccaaaaccctttcaaaaagatgcaagggcgtgttgttcatgttcttttccaccctagccgagcaattttctttgttgctacaaagacacatgtccgggtttatgaccttgtcaaacaacagcttgttaaaaggcttgtgacaggtctgcatgaggtttcatccatggcagtgcatcataaaggagataatcttcttgttgggagcaaggagggaaaagtgtgctggtttgatatggatctttcaacacaaccttacaagactttaaagaaccattccaaagatattcattctgttgcattccatgattcttatcctttgtttgcatcatgctcagatgattgcaaagcatatgttttttatgggttggtgtattctgatttgcttcagaatccattaattgtccctttaaaggtgcttcaaggtcaccagagtgtaaacggcatgggtgttttagattgccagtttcatcctaagcagccgtggttgtttacagcaggggctgattcagttgtaaagctatattgtaattaatttatcatcccttcagcagaatcagtcaatatgaaggcgacattattgtgccaaaattgggagggtaaaagactaccgtgttaataattttgcatatgttcaggggtattaaaaattcagaggataaatttcctcactctcaagtgttagatggttttattcgagaaaaaagacagtcaattctatatcaatatttgaaagtggaggcttgttggaggttgtcatttatagaaaacagctctaatatgtatcgttatattgaagggagagatcattaatgcttttgtatcaagcatagggtgatattttgacgtgatgttcaaaattattgtaggcatatgacgggatttttgacaaggcctcaggttgtttctcgagatgctacatgaagatttatgtttcaagttccaaatttttttttggtttaaagttccggtatttagatatgccgagagcttgattggaccgagagcttgaatatattccgaatcttgatcttaaaaaaaaaa

SEQ ID NO: 219 - DNA, 1299 bp, Pinus radiata
acatttctcgctaaacagagccaaattcaccttctggctgacgctgcaacaggttgggtgatccagagcttcaatttgaatattcaaagcattttttagctcaaagttctaccgtttccagattaagaagttaggtgaagagaaattctcttcctttttcttaagtaccttgatttaagaaacagaatgatgtctctaaaaagaggattcgaagaatccttggtaccagccaaaagacagaaaacagagttgtccactgtcacatatggtgatgggcctcgacggacatccagtttggaatccccaatcatgctgctgactgggcaccatgcagctatatatacaatgaagttcaatcccacaggaacagtgattgcatctggatcacatgagagggagatatttttgtggaatgtgcatggggattgcaagaattttatggtcttgaaaggtcacaagaatgcagttttggatctgcactggacaaccgatggctgccaaatcatatcagcaagccctgataagactcttcgtgcctgggatgttgagacaggaaagcaaataaaaaaaatggcagagcactcatcctttgttaattcttgttgtccttcacggcgtgggccccctcttgtagttagtggatctgatgatgggactgcaaagctctgggatttacgtcacagaggagctattcaaacctttccagacaaataccaaatcacagctgttgggttctctgatgccgcagacaagatatactctggtggaatagataatgaaattaaggtgtgggaccttagaagaggtgaggtcacaatgcgactccaaggccacacagacacaattacaggcatgcagttaagttctgatggctcttatctcctgactaattcgatggattgttctcttcgtatttgggatatgcgtccatatgcccctcagaatagatgtgtgaaaatcttaacaggccatcaacacaactttgaaaaaaaccttttgaaatgtagttggtcttctgatggaagtaaagtcacggctggtagtgcagatcgtatggtttatatatgggacacaaccactcgacgtatattgtacaagctcccaggccacactgggtctgtaaatgagactggtttccatcctacacagccaattattggatcatgtagtagtgacaagcagatatacttaggggagattgagcctaatgttgggtatcaagctgtaatttagacatgattcaaagtctagacattaatgttttggaactcttttttcgaaaaaaaaagaaaaaaaaaa

SEQ ID NO: 220 - DNA, 1971 bp, Pinus radiata
ggagttttttgctctgttggagattgtgaaaaggcagaggagcagaggctatggagttcagcgacacatataagcacacagggccttgctgtttctctcctgatgcacgctatttggccatagccgttgactacaggctggtgattcgagatgtcgttaccctcaaggttgtacagttgtattcatgcatggataagatcagcaatattgagtgggctcttgattcagagtatattctttgtggtctatataagagagcaatggttcaggcatggtcattatcacaacctgaatggacatgcaagatagatgaggggcctgcaggaatcgcccatgcaagatggagtcccgacagtcgccacattattacaacatctgacttccagttgcgtctcacagtctggtctcttgtcaatacagcctgcatacatatacagtggcctaaacatgcatctaaaggtgtttcatttacccaggatggcaagtttgcagctatagctacacggcgagattgcaaggactatgtgaatcttctttcttgtcatacgtgggaagtcatgggcacatttactgttgacactatagatcttgcagatcttgaatggtcaccaaatgatagtgcaattgttgtttgggactccccacttgagtacaaggttcttatttactctccagatgggcggtgtttatttaaatatcaagcttatgacagttggctaggtgtgaagactgttgcatggtctccatgtagccagtttctggcagtaggcagttatgatcaaacactgaggactttgaatcaccttacttggaaaccttttgcagaatttgtgcatgtgagcactgttcgaggtcctgccagtgctgttgtttttaaggaagtagaggaaccatggaatcttgatgtgtctggtcttcacttgaatgatgacaatgctcatgacatccaagatggcaagccagctgaaggccattctagggtccggtacaaggtagtggaatttcctgtcaatgtatcttcacaaaagcatcccgtggataaaccaaatccaaagcaaggcattggcttgctagcgtggagtcgagatagccaatatttgttcactcgtaatgacaatatgccaacggcactttggatatgggatatttgtcgccttgagcttgctgcacttctgatacagaaagagcccattcgtgcagctgcctgggatccagtatatcctcgtgtggctctttgtacaggaagctcgcatttgtacatgtggacaccctctggtgcttgttgtgtgaatattcctctgccacaatttgtcgtatcagatttaaaatggaacccagatggaacttctatgcttctaaaggatcgtgagtcgttctgttgtacttttgttccaatgcttcctgaattcaacgacgatgaaactaatgaggaatagtacacacaaagcaaaaagtgtatccaacatcacttgtgacaaggccatcgttgtctgcgaatcttcttggtcaactacaaatgacctctgtatacttctcctggtcgttgacactctagtgctcacaacagtgattgtttactagtttcagctatgtcttaagtgtctcctacattctgcaacaagttatttagctgtaccattgttgaaattgtgcaaagttgatccttggagagtttattccaatgtttaagatacaacttgctgcagtgccttaggagttccaattcttcccattcagctatatgaatagcaactaagtggttatagagcttctctccattcttattacttcactcgaggacgtgatgtctacttcaatttttataatataatgttggatttatctatcgaccttttattcattctcttagtctttgctagtgtaggcatcaattcttattataaatatattgtactggggatccaagacatggcaatatatgtcgagattttcattttctcaaaaaaaaaa

SEQ ID NO: 221 - DNA, 2592 bp, Pinus radiata
ctgccacccacatggtagctttcttgtaaattgcagaagtgttaccatattgtgattaaattaaattgtgtgctgtttttatagtcattccctgcatttttccctgaacgtttcaatccattacaggccctttttcttggtgtcagttggtcgaatcgcgtgagcccttgctagattccaatcccgtccactgctgcgtagtctattcgtctctctcattttgctgtttgatatgattatgaggctttgaagtctatcgcacttaaaaagctaatcgccaatttagcagaaaaaaactgacccatcttagataagccctccaaattctactcatgagccctgttttgcacaaagtttagcatacaaatagacccctctgagacaagccatcaaaggtccaatccctctggtttccttttccttcaaatttaaccgaaaatcggcagataaggccccataatcctacccataaacctgttttctcttaattttcgcatacgacttgattgatttcggatattagtatggccaagctcattgagactcattcctgcgtcccttcaacggagaggggccgtgggattctcatagcaggagatgcaaagaccaactctatcatatactgcaatggccgatccgtgatcatgagaaacctggacaatcccctggaagcttctgtttatggagaacattcatatcctgcaactgtggctcgcttctcaccaaatggagagtgggttgcatcaggggacacttctggcacagttcgaatctggggacgaggttcggatcatactctcaaatatgagtacaaggctctcgctggaaggattgatgatctcgagtggtctgccgatggacagcggatcgttgtatgtggagacagtaaaggcaaatcaatggtccgggctttcatgtgggactctggcacaaatgttggtgaatttgatgggcattcaaggcgtgttctaagttgttcctttaaaccaacgcgaccattccgtgttgccacatgtggagaggacttcttggtgaacttttatgaaggaccaccctttagatttaagacatcacacagagatcattcaaattatgtgaactgcgtaaggttcgctccagatggaagcaagtttattactgttggttcggatagaaaaggagtgatttttgatggcaagatgggtgaaaagattggggagttgtctaaagaaggtggacacacgggcagtatttatgctgctagctggagccctgacagtaaacaggtacttactgtgtctgcagacaagtctgctaaaatatgggagattagtgaaactggtaatggaactgtgaagaaaacattgacttttggaagccaaggaggagctgatgacatgctagttgggtgcctttggttaaatgattatctgattactgtttctcttggtggcatcgtcagcttactctctgcagttgatccagataaaccaccaaagacaatttctggtcacatgaaaagtataaatgcaattgcattatctcttcaaagtggacaaagtgaggtttgctcaagcagctatgatggtgtaattgttagatggattcttggagttggctatgctggtcgggtagagagaaaagatagtactcaaatcaaatgcctggcaacaattgaaggagagctggtaacttgtggttttgataataaggtgagaagggtacctctgctatcagagcaacataaagagtcagaaccaattgacattggagcacaaccaaaggatctagatgttgcagttggttgccctgagcttacttttgtttccaccgatgctgggataataattattcgtgcgtcaaaaatagtatcaactactaatgttgggtatgcagtgactgcagctgcaatatcacctgatggaacagaggctgtggttggtggtcaggatgggaaattgcgtgtgtactccatcaaaggtgacactcttctggaagagtcagtccttgaaagacatcgtggtccaataaatgcaatccgcttttctcctgatggatccatgtttgcatcgggagacctgaacagagaagcagttgtgtgggaccgtattactagagaggtgaaacttaagaacatggtctaccacactgcacgtatcaattgcattgcatggtctccagatagctctaaagtggcaacaggctctcttgacacctgcatattgatatatgaggtgggaaaaccagcatccagccgaattacaattaagggggctcatttgggaggggtttatggtctagcttttagtgaccagagtactgttataagtgcaggagaagatgcatgtgtccgtgtgtggagtctcccatagctctgtaatgtctggatctaataatttatatttagggtatagggatagatgtctcgacatacgagcatggttcttgatgccatcttgtgccatgtttgtagtgcttttgcatgagttcaaatgtctttgtgacatattgtcttgaaccaccgaggatatatcatatttatcttgtagatggtttcaaacggtgctgcttatctgggggtaatggggagcatggagtttttcaaaaaaaaaa

SEQ ID NO: 222 - DNA, 1333 bp, Pinus radiata
cttgggccaccaccttctctagtagctgaatcttgcagggggtcgaagtctgtttttgaagaccagattgcagcctattacccaaccaaatcaggccttgttgttgggttgctacaagtgacaatatctaagtattgaccagggtgaagagatgccacaaccgtcagttatccttgcaacagcaggttatgatcacacagtaaggttttgggaagccactagtggccgctgctatcggactcttcagtaccctgattcacaagtcaaccatctagagataacacctgacaagcagtacttggctgcagctgggaatccacatattcgtttatttgaagtcaattccaataatcctcaacctgtaattagttatgactcccacacaaacaatgttacggcagtgggattccagtgtgatggaaaatggatgtactcaggttcggaagatggtactgtgaagatatgggatctgagagctccaggtttccagagggagtatgaaagtcgggctgctgttaatactgttgtcttgcatccaaatcagacagaattgatatccggagaccaaaatggaaatattcgtgtgtgggatctcaatgcaaattcttgcagttgtgaactggttccagaggatacagctgtaagatcattgacagttatgtgggatggaagtctggttgtagctgcaaataatcatggaacatgctatgtttggaggttgatgcgtggaacacagacaatgacgaacttcgagccattgcataagcttcaagcacataattcatacattctgaaatgtcttctttcacccgagttctgtgaacatcatcggtatttggcaacaacatcatctgaccaaactgtaaagatatggaatgttgatggcttcactctggagcgtacactaacaggacatcaacgttgggtttgggattgcgtattttctgttgatggagctttccttgttactgcttcctcagattcaactgcaagactgtgggacctatcaactggagaagccatcagaacatatcaagggcatcataaggcgactgtatgctgtgctctgcatgatggcacagatggtgcttcttgctgatgccttgtttgtatgtccaatagattataacctatttactgtgacactattcttcacacccatgtcaattgtccaatgtagcatgccccgcaccttgtacagaattgttagagcaagttgtacttcaggtcgtagagttgcttttcacttgttatttgtgtaagtgtcattagattaatatgaaattaatatgaaagattgtacgctagctgtgatggacattaggagagaaat

SEQ ID NO: 223 - DNA, 4652 bp, Pinus radiata
acttctcaaatacctatagtagaatcggaattgccatgtatttacttcacttctttaatcataaattctcataaacacctgtcgcattttccatttcatccgattgggctcaatcggaggtcattcaggctgattatttggattctgaaaagagggattccagccttaaagagccttcaagctcccgaagttctgcttcagagagagggattcgggaatttcacaaggccaaattccggaaaataggttcagagcagaggatctggatttaaattcgatttaaaagtcgattcttgtttgaattcaaacctccttcgtagatctgagatttagaggtttattcttttggagctttctagtttgagggtatatgtgagatcatatatcggatccagttgatagtccactaaagtttcttttttccttctactgtttaattcattttgcaacattgtgaaaattggtttcaatgttaaccaaatttgaaaccaagagcaatagggtaaagggtctcagttttcatccaaagaggccatggatcctggcaagtcttcacagtggagttattcagttatgggactatcggatgggaactctgatagacaaattcgatgaacatgatggacctgttcgaggagttcattttcacaagacacagccactctttgtgtctggaggtgatgattacaagattaaggtctggaactacaagatgcgtcaatgcctctttacatttgtagggcaccttgactacatccggacagttcattttcacaatgaatatccttggattgttagtgcaagtgatgatcagacaataaggctctggaactggcaatcacgggtttgcatctctgtccttaccggtcacaatcactatgtgatgtctgcttcctttcatcctaaggaagatctagttgtttcagcatcgttggaccaaactgttcgtgtatgggatataagtggccttaggaaaaaaactgtgtctccagctgatgatctttcgaggctggcacagatgaatacggatctttttggcggtggtgatgttgtagtgaagtatgtactcgagggacatgatcgtggtgtgaactgggctgcttttcataccagcttgccattaattgtttctggtgcagatgaccgccaagtcaagctgtggcgaatgaatgatacaaaggcttgggaggttgacactctacggggacatacaaacaacgtgtcctgtgtgatttttcatgcacgacaagacattattgtttcaaattctgaagataaaagtatccgagtgtgggatatgtccaagcgaactagtgttcaaacttttcgtagagagcatgatcgattctggattcttgcagcacatcctgagatgaatctcctagcagctgggcatgacagtgggatgattgtgttcaaattggagagagagaggcctgcttacgttgtttatgggggctcgctgttgtatgtcaaggatcgttatctgcggacttatgagtttgcaacccaaaaggacaatccactaataccaattaggaagcctggttccattggtccaaaccaagggccaagatctttgtcatacagtccaacagagaatgctatcttaatttgttcagatgctgatggtggtgcttatgaactttatgctgttccaaaggatagtcatggcaggagtgatacagtacaggaggcaaagaaaggattaggaggatctgctgtctttgtggctcgcaatcgatttgctgttcttgacaagaatcacaatcaagtcactatcaagaatttaaaaaatgaggtgacaaaaaagttcgatcttccagtcacagcagatgcacttttctatgcagggacaggcaacttgctttgcagatcagaagatagtgtatttttgtttgatatgcaacagaggacggttttaggagaaattcaaacccctaatgtcaggtatgtagtttggtcaaatgacatggagaatgttgccttactgagtaagcatacaatcattattgcaagcaagaagctgtcaagtacgtgtagtctgcatgaaactattcgtgttaaaagtggggcttgggatgacaatggcatttttatgtactcaactttaaatcacataaagtattgtctgccaaatggagatagtggcattatcaagacgctggatgttccagtatacataacaaaggtttctggaaagtctctctattgcctcgatagagacggcaagaaccgtgttatacagatagatattaccgagtgtcttttcaagctagcactcagcaaaaagaaatatgattatgttataaacatgattagaaactctcagctttgtggtcaagcaatcatagcttacctacagcagaagggatttccagaagtggctcttcactttgtcagagatgagagaactcgattcaacttggcagtagagagtggaaatattgaaatagctgttgcttctgcaaaggaaattgatgagaaggatcactggtacaggctaggagtggaggcccttagacaaggtaatgctggaattgtagagtatgcctatcaaagaacaaagaattttgaaaggctttcttttctatatctcataactggtaacctagacaaattatcaaagatgttgaggattgctgaaatgaaaaatgatgtcatgggccaatttcacaatgcactatatttgggtgatattcaagagcggatcaagattttggaggagtctggccacctgcaccttgcttatgccactgcatcattgcatggtcttgcagacattgctgacaggcttgcagctgatttgggtggcaatattccagttttacctccagggaaaaaatcatcacttctaatgccacctgcccccattctgcatggtggtgattggcctttgctcagggttacgaaaggtatttttgagggtggtttggagaattccacttctgcagcttatgaagaagaggatgaagaagctgctgctgactggggtgaagacatagatatagaaaacattgaaggggaaaatggtgaggctacagtgttggatgatcaagaagttaaaggtggagaggatgatgagggaggatgggacatggaggatttggaacttcctccagacgtagctgctgctaatgtaggaaccaatcagaagacattgtttgtagccccaacattaggtatgccggtaagccaaatttggatgcaaaagtcttctctcgcaggtgagcatgcagctgcaggcaactttgaaacagctttacgtctactgactcgccaactgggcattaaaaatttctctccactgaaacctctatttttggaactttatatgggtagtcatacattccttccttcctttgcttctgtacctgctttttccttggcactacagagaggatggagtgaatctgctagtccgaatattagaggtcccccagccttggtctataggctttcggtgctagaggagaaactaacggtagcctacagggccacgacagaaggtaggtttagtgaagcactgaggctatttctgaacattctgcatacaattccagttattgtggtagactcaagaaaggaaattgatgaggtaaaagaattgattggaattgctaaagagtatgttcttggtcttcggatggaggtcaagagaaaagaaataagggatgatgctgttcggcagcaggagcttgccgcttattttactcattgtaatctgcagaaagctcatttgaagctggctttgctaaatgcaatgggtatttcttatagatgtaagaactataatacagcagcaaactttgctcgaaggcttctggagactgacccttcttcaaaccatgcaacaaaggctcgacaagttcttcaggtctgtgagaggaacttgcaagatgcgacacagctcaactatgatttcagaaatccttttgttgtctgtggggcaacttttactccaatataccgtggtcagaaagaggtgtcctgtccgtattgcatggctcgttttgttcctgacattgctgggaaactttgttcgatatgtgatcttgcaatagtgggttcagatgcatctggactattttgttttgctactcaaacaagatgatcttagctttacagaacaatgattttgtgatgccttttatattctttgagaggtaaattgtttgctgccatttcccatcagtatatgcaagaaatgtttccatttatgtcagttgataccaacaggggcgtcagaataatcgtacaatgcatgccaggcttacgtaagcaacatgtgaggatatttatttaaacattataagaagcaggacgcatgcatgttttatttgctgtttcagttccagaattgaagcatgcacgctgtcttattagctgtttcagttctggattttgtttgctgttcttcttagtaaggcagaaagctttactcactttgtaagatgtgatgtaggaattttgtttacagtgcaggatggctatgccctctattgttctctattctgtgcattgtggcaaatggttttgttataccatttttttggccttgtaggtgaataattggatttgcttgaaaaagtcaatcatcttaattcgaggacctaataaaggttactacttgaagcttttcaaaaaaaaaa

SEQ ID NO: 224 - DNA, 2365 bp, Pinus radiata
cccgaagggcaactttgacgtcacaatagtcctaagtgacggggccgcacaaccagactgcttatgaataccaggctccactacccattgcaagacatttagtcagttcaaagggagcgctctattaaaaaaattcctcttgtaaatcgttgcaagagagcttgccatccaacaacaacaacgactccaggacgaatggatttactgcagaattaccaggatgacagtgaagattcgaacccagaacttagaaatcatccaccgctggaagacgccacggccacttcggcgcccgcaggagtcgaaaatgagacctcttcttcaccagactcctcccctttgcgccttgcattgccagcaaaatcttgcgcacccgatgtggacgaaaccctaatggccctcggcgttccaggctccgagaaaaaaaacaatcacaacaagcccatcgaccctacgcagcacagcgtgacattcaatccaagctatgatcagctctgggccccgctttacggccctgctcatccttacgccaaggatggtatcgctcagggcatgagaaaccacaagctcggttttgtggaggattcggccatcgaaccgttcatgttcgacgagcagtacaatacttttcacaggtatggttacgctgccgacccttctgcttctttgggtagtcatattgttggtgatttagagtctttgaaaaaaaacgatggggcatctgtgtataatttacctaaacgtgagcataagaggcagaaactcgagaaaaaaatgatacagaaggacgagaacgaggaggaggaaaaagaagttggagaggaagttgacaatccttccacggaagagtggctgaagaagaataggaaaagcccttgggctggtaagaaggagggtttgcagactgaattgactgaggagcagaagaagtatgctcaggaacatgctgagaagaagggtgacagggagaagggtgagaaggttgaaattgtagataagactactttccatggcaaggaggagagggactaccaggggaggtcttggattgatcctcccaaggatgccaaggcaaccaatgatcattgttatattccgaagaggtgggtccatacatggagtgggcatacaaagggggtttccgctatccgattcttccccaagtatggtcatctgttgttatctgctggcatggatacgaaggtgaagatctgggatgtttttaacagtgggaaatgcatgaggacttacatgggtcattcgaaggcggtgcgtgacatatcattcagcaatgatggttctaggtttttgagtgctgggtatgatagaaatatcaaattgtgggatacggagacagggaaggtgatttctacattctccacagggaaaataccatatgttgtgaagctccatccggacgaggataagcaaaatgtgctactggcaggtatgagtgataagaagatcgtgcagtgggacatgaatagtggtgagatcactcaagagtatgatcagcatcttggtgctgtgaataccattacttttgtagataataataggaggtttgtgacatcgagcgatgacaagtccctgagggtttgggaattcggcattcctgtggtcattaaatacatcagtgagcctcacatgcattcaatgccttcgatttctcttcatccaaacacgaattggcttgctgcacagagtttggataatcaaattctgatctacagtacaagggagaggttccaactcaataagaagaagaggtttgcggggcatattgcagcaggttatgcttgccaagttaacttttcacccgatggacgatttgttatgtccggagatggcgagggcagatgttggttctgggattggaaaacttgtaaagtcttcagaactttaaaatgccatgacaacgtttgcataggctgtgagtggcatcctctggaacagagcaaggttgctacatgtggctgggacggaatgattaaatattgggattaaattcagtacaataaatgcaagatctctaactcaacttgagtatgtatgaaggtgccgtatcaaaagattggtacttccttatggacacacaagatcgtaagcatggctgaattgacttgaggaaaatgaaacgaccttgctaattgtaatgatgtagaggcctcatgtggtacctggttgtctaccagactatactatacagtctgtcctacctttcgaaggaaacttttgagtgactcatgtcaatttgttcttgtatttgacctccaagagatgtaacattgaatttgatttcacctccatggtttccaagatgtgaatcttttattgcttatttgttcacactggaaaaaaaaaa

SEQ ID NO: 225 - DNA, 1774 bp, Pinus radiata
gattgctctaatatgaaccagctcaactggacgctctaaacttacgtatgattgaacgaagtgtttggcgcttgtttcgccttataaatagtgcttcttgtatcagtgcgtattgcatcagtgtagtgaacactttgaaaggagtttgggcttcgactctctaccctgtaaacaagttcagcttaaacgctgttgcagtaaaaggtgttgaagatggcaaggaagggtttgggtactgatccggcaataggctcgttaatgtcatcaaagaagaggaaagagtataaagtcaccaataggtttcaagagggcaagcggcctctttatgccattgctttcaatttcattgatgctcgttatcataatattttcgcaacagcaggaggaacccgggtgaccatttaccaatgcttggaaggaggtgctatttctgttttgcaggcatatgtggacgatgataaggatgaatcattttacacattaagttgggcatgcgatgtgaatggttcaccattattagttgctggtggtcacaatggtataattcgagtgcttgatgttgcaaatgaaaaggtccataagagtttcgttggccatggagattctgtgaatgaaataaggacccaagcactgaaaccttcccttattttatctgctagcaaagatgaatctgtacgactatggaatgttcaaactggaatatgcattttgatatttgctggagctgggggacatcgcaatgaagttctcagtgtagattttcatccttcagatgtatatcgtattgcaagctgtggcatggacaacacggtcaagatctggtctatgaaagagttttggacctatgttgagaagtcatttacctggactgatttgccatcgaaattccccacgaagtatgtgcaatttcctgtttttattgctgcagtgcattcaaactatgtggattgcactagatggcttggcaacttcatcctatcaaagagtgtggacaatgaagtagttttgtgggagccttacagcaaggagcaaagtactagtgatggagttgtggacatcctgcagaagtatccagtgccagaatgtgacatttggtttatcaagttttcatgcgatttccactataattctatggcagttggcaacagggaaggaaaagtttatgtttgggaattacagtcaagccctcctaatttaattgccaggttatcacatgcacattgcaaaaatcctattagacagacagctatatctcatgatggaagtaccattctctgctgctgtgacgatggtagtatgtggcgctgggacgtggttcagtaaaatcagcaatttccttgctgaatgtgcattcgtatatgtttcagatatttacacctgcacactaatgactttgattgttattagcttctggttgatgttgtggaaaatcctggctttagccaagctttttgttttgccagaatagtcaacagagttttctgtttgctagaatacagcatgcccatttttataaagctacactttgcgggacatttgaaactagtatgctccccagggccttgtgttcataaagatgccttcaatgattcagttgttattatcatctttaatggaggcaatggtctattcacatcagatagttgatggccacatgagttgtttatacaagtcgttgttttatgagagaaccttcttcagatgaattaaaggtatcaatataactatctcagtaatttgaaaaacctaggatgttgttctggcaaaaaaaaaa

SEQ ID NO: 226 - DNA, 3107 bp, Pinus radiata
gcagctgaaagcgctcaaagcgctcgccatggcaattccacagtgaagaagaccagagcagggagtaatggagtctggggcaggaggttcagttggggctcgcgtgccgtctgcgaagccagagatgctgcaacagccaccgtattctaacggtgacgatgataatgatatggagcgtggaacggcacccgtcccgtcttcgaatcccaatactgtctcgaaatgggagctggacaaggattttctgtgccctatctgcatgcagacgatgaaggatgcgttcctcacggcttgcggccacagcttctgctacatgtgcatcatgacgcatctcaataacaagagcaattgcccctgctgtagcctctatctcacaaacaatcagctctttcccaatttcttgctaaataagcttttgaagaagacatctgcatgtcaaatggcaagcactgcttcaccggtagagaatctctgcttgtcgctacaacagggagcagaagtctcagtaaaggagctggattttctcttgactcttcttgctgagaagaagcggaagatggaacaagaggaagctgaaactaatatggagatactcctggacttcttgcaacgattgaggcagcagaaacaggcagagttgaatgaggtgcaagctgatctccattatatcaaggatgacatattagcattggagaaacgaagactggaattatctagagctagagaacgatattctaggaaattacatatgcttttagatgacccaatggacactacattaggtcatgctgcaattgatgatggaaataatgttcgcacagcttttgtacgtggtggccaaggtgatgctatttcagggaaatttcagcagaaaaaggctgaaatcaaagcacaagctagttctcaagggatgcaaaagagagctaatttttgtcattctgattcccaggttttgcctactttgtcaggattgacaatcgcaaggaaaagaagagtccttgcacagttcgatgatttacaagagtgctacttgcaaaaaaggcgacgctgggccactcaattacgaaaacaatgtgatggtggcttgcgaaaagaaagggatgggaacagtattagtagagaaggctatcacgcaggccttgaggaattccaatctattctcacaacatttactcgttacagccgtttgcgggtcatttcagaacttcgacacggggatcttttccactctgcaaatattgtatcgagcattgagtttgatcgagatgatgaactatttgcaactgccggtgtttccaggcggatcaaagtgtttgactttgcaacagtagtgaatgaacctgcagatgtgcactgtcctgttgtggagatgtccactcgatctaagctaagttgcttgagctggaacaagtgtatcaagtctcagattgccagcagcgattatgaaggcattgttactgtctgggatgtaaatactcgtcagagtgtcatgatgtatgaagaacatgaaaaacgggcatggagtgtggatttttcacgcacagagccgaccaggctcatctcagggagtgatgatggaaaggtcaaggtgtggtgtacaaggcaagaaacaagtgttctcaatattgacatgaaagcaaatatttgttgtgtcaagtacaatcctggatcaagctattatgttgcggttggttcagcagatcatcacattcattattatgacttgaggaaccctagtgttccattatacgaatttaatggtcataggaaaacagtttcctatgttaaattcatttcaacaaatgaactagcttctgcatctacagacagtacactgcgcttgtgggatgtgagggataattgccttgtacggacatttaaggggcacactaatgagaagaactttgtggggcttacagtcaactctgaatacatagcttgtggcagtgaaacaaatggggtgtttgtgtatcacaaggctatttcaaagcctgctgcttggcatcaatttggaagtccagatttggacgacagtgacgatgatacatcacatttcataagcgctgtttgttggaagagtgagagccctacaatgttagctgctaatagccaaggaacaattaaagttcttgtacttgcaccgtgaatttcaagtttctcatataattcttcaaggcccttcctagatatcagagttggagagaattttgaaatttcttaaattaagattctttctggaaattagctctctggatttcttgctgcctgagaatgttgagaaatgaggttgatgtggattatatgcgcaattttcaatctactcatatttctatagtgccatatgcttgtcggttgtcattgacctctaatagaatagccagagtatcttccagtgatgcggcatgttattgcatgtgctatatgcccctcttaacactaatctgaaggaatatcggcctcaatttggcaagttctttggtctggggcgagccaactggtgaagtctaagactatgaaggctaaattttttaagggtgtcagaactcgaggaaagattcaggagatggagaatgcccaggagtaacattttgtactgatactaaatgtattatatcttggtcttttatcgttcttggaatacttgctagctgtcatcacacatttttatgcttgaactacgaggaatagtgaagcgttgccccaacttatgggcttccctcttcaactattattttgtactgatgctaaatgtattatatcttagtcagtcttttatcgttcttcaatactcgcctgctgtcatcaaacttttctaggcttgaactacaaggaatagtgaagcgttgctctaacttgtgggcttccctcttcaactattattgggatttgcttctagagccaaatagttggacactatcagagcttagagaattgtttatatcggttccctgtaaaagtttgtatttgagggcagtccgtgtcccttgtcaatacttatgagttgcagctcatagattttttcaagtcccaagatcagcaacacgtaaatgaacatgaaataaatattgtaaaattgtgtattggtaaatttgttgaagaaataacaa

SEQ ID NO: 227 - DNA, 4012 bp, Pinus radiata
ttccttcccgctgagttgctcgacttctactaggaagattttaggtatcccgcaaagtttaacgcatatcagtctctccttattcccaatgagttgctcgacttctataagacgattttcggcatcccccaaagttatgcgttatgttaacgcatatcagtatctccttgctatcacagttggacgcccagaggcagcttcccattagtcgaagccgccctggaaaaaaaacgggtaggttttaaggtgttttttttgttttttgtattacgaaagtttttgaacttcatatggttccagaccaaccttggatgaattttaatcaaatttcaagtgaacgcgtctcagcctctccccgtggtcacagtttgacgcttagacacagaatctctgctagtccaagccaccccggaaaaagcgggttcagcttgaagttcggtggacctcatcaaataaattcgaccgtcaatgaagttctgcgaatttccaatttaattgattttgttcgccgaacgcggtcacttatgctcaaagcaccagtttaaccatcaacggcagagtcaaaggcagcatcacaaccaatttatattttatacctagcagatccaattgatcaagtagcataagaagcgtaggtagtggaggaataaacaagggtgaaaaaacaagttatcgggactgtgaatacgttagctgaccaagtgtatccattacgagtagacccagtatcattcattggagattgcggtccagcagtttcataccctattttacgggaaaaagcaataatccctacttactggaacagcagcatcaggccaagccctagataagctttctgaagtatttgggtaattgaaacggtgcgtagccatggccaactatgtggactcgaagaagaatttcaagtgtgttcctgctctgcagcaattttacacagggggtccattcaggttgtcttcggacggttcatttttagtgtgtgcgtgcaacgatgaagtaaaagtggtagacttagccaccggttctgtgaaaaatacgttggagggagattcggagcttattgttgcgctcgcactcactcccgataacaagtatttgttctcagcaagccgcagtactcaaatcaaattctgggatttatcctccgccacctgcaaacgaacctggaaggcacataatggtcctgtggcagacatggcctgtgatgcttctggaggattgcttgctacagctggtgcagacagaagtattcttgtctgggatgtggatggaggctactgcacacattcatttcgagggcatcaaggagttgtaactacagtgatattccatccggatccccattgccttttgcttttttctggaagtgatgatgcaacggttcgaatatgggatcttgttgctaagaagtgcatttctgtgctggaaaagcatttttctactgtgacgagtttggcaatctctgaaaatggttggaatttgctcagtgctggtagagataaggttgtaaatatatgggacctgcgtgattatcactgccgggcaacaataccgacatatgaaccactagaagctgtttgtgttctcccaactggttctaggctggtgtctgttatgaaccaaagccgggcattgcctgaaaatcgaaagaaaagtggtgcggctccagtgtattttttgacagtaggggaacgtggcattgttcgtatatggtattcagaaggtgctctgtgcttatatgagcagaagtcctcggatgcaataattagctctgacaaagacgagttgaagggaggctttgtatctgctgttctactacccctcactcaaggagtgatgtgtgttactgctgatcagcgttttctcttttacaatctggatgagagcgatgaaggaaaatgtgatttaaaggtcagcaagcgtcttataggttacaatgaggagatagtggacttgaaatttcttggggatgaggagaagtttcttgcagttgcaacaaatctggagcaggtgcgcatgtatgacctttcatcgatgacatgtgtatacgagttgtcaggacacacagacatagttctttgtctagatactgttgttttttctggacatagtctgttagcttctgggtccaaagatcacacagtaagaatttgggatacagagagcaaatcctgcatatgtgtagcagcagggcacatgggtgctgtaggagctgttgccttctcaaagaaagctaagaacttctttgtgagtgggagcagtgatcgcacaatcaaagtatggagttttgctagcgtactagattttggtggtattagtaagtcaatcaagctttcatcacaggctgcagttgcagctcatgacaaggacatcaattctgtggctgttgctccaaatgatagtcttatctgtactggttctcaggatcgaacagctcgtatatggagattaccagatctggtaccagtactagtgctaagaggccacaaaagaggagtttggtgtgtggaattttcacctgtagatcaatgtgtgatgacagcatctggtgacaagacaatcaaaatatgggcattatcggatggctcttgcttgaagacatttgaaggtcatactgcaagtgtactgcgagcttccttcctcactcgtgggacacagtttgtttcttctggtgcagatggcttgttgaaattgtggacaatcaagtccaatgaatgtattgcaacatttgatcagcacgaggacaagatctgggcaatggctgtgggcaagaaaacagaaatgctggcaacaggtggcagtgattcccttgtgaatttgtggcatgattgcactaccacagatgaggaggaggctcttctcaaagaggaggaagcggcattgaaagaccaggaattactaaatgctcttgcagataccgactatgtgaaagcaattcaacttgcatttgaattaagaagaccttataagctccttaatgtcttcactgaactgtacagcaaaggacatgcccaggaccagatacagaaagtgatacgtgaactaggaaatgaagagctaagattacttttagaatatgtgcgagaatggaatacaaagccaaaatttgcccatgttgcccagtttgtattatttcaacttttcaacgtccttcctccaaaggagatcattgaggtacaaggtattagtgaacttttggagggtcttataccatatgcacagcgacattatagcaggatagatagacttatgagaagcacttttttgttggattacactctttcatcaatgtcagttctctctcccacggagacagatttgtcatcatctaatttattagctagaacagctgatccactgcatgcacagattgatcagtttcacccaacccatttccctgagccaaatttgactcctatacagtctcttttagattcaggcaatacagattctgtggaagtcacagcacgacgagccaagaagaaaagagtgtcaggtaatgattcagagaaaacaactgttgctgaagttaaaattggtgacatggagaatgcatttgatgagcctgacgtggcagatcaaggttcatccaggaagcataaacctgcgagttcaaagaaacggaagtctatagccgttggaaatgccagtattaagcgtattgcaagtggaaatgcagtcactattgcattgcaagtataaggccttgttgatgaagtttgatctaccattggttttggaattaatgtgaactctgtagcaggattgctgagcaggatttagaggaacggctgtatgttaacttgaaatttgtgtgtcggtcaagggttgcgggtgcaacatagagaaatgtgtgccaacatttggtgtaccgaatgtcttcaatctgtaagattttcacggcagttgaactagtcatagtggaatattatttaaatggtgtattctagtcacattatttccaattttgatagtatctgggcatctgctcattaattcaaaaaaaaaa

SEQ ID NO: 228 - DNA, 2426 bp, Pinus radiata
ccacatcaattgacctggtttgtctgattgtgcagatagctttgctccggggcaaggagaacgccaagaggacaccagggcttctgatacttggctcgctcgctaactttttggagaaccagacgtcctcatactttgaggaacctaagcttttagaattggaattcatttggaactactgtttttttttttttcgttttgcagaaccaaacatcctcattctttgaggaaccctagcttttagaattaaaattcctttgcgacttttgatttttttggttttgcgagtttaaatttaggcacattgattgtttgtcatattttgtgttttgtctggttattttacttgagtaggagtaatggaatcgtcttgcagttcaatgaattccaacaggcattccacagagaagcgatgtctacgtcctctgcagaaacagggtgcttcaatgaataaacacagcagcgatagatttattccggcaagaggatccatcgatttggacgtagctagattcatggtcacgcaaaagcaaaaggacaataacgatatccatgccctctccccttccccctccccttccaaaaaagcataccagaaggagatggcagacactttattgaagaatgccggtgctgctgacaacaattgcagaattctttctttcaatggaaaatcatcgactgtttcccaaggttcacaagaaaatgtgttggctaatctctctatttctagaagagcacgcagatatattcctcagtctgcagatagaaccctggatgcgcccgaccttctcgatgattattacttgaatctattggattggagttccaccaatgttttgtccacagccctgggcaacactgtatacttgtgggatgcttctaatagctctatatctgagcttctgattgcagatgaagaagagggtcccgttaccagcgttagttgggcacccgatgggagccaaattgccgttgggttgaataattctgttgtacagttatgggattcgcaatctaataaaaagctaagagccttgaaaggtcatcatgaccgtgttggtgcactttcttggaatggtcctattctcaccacaggagggctggatgggattataatcaatcatgatgttcgcacccgtgaccacattgttcaaacatacaaaggacatacccaggaggtttgtggattgaaatggtctccttccggccaacaacttgcaagtgggggaaatgacaatctactctatatttgggacaagagcatggcatcccataatccgtcctctcaatacttccaccaattagatgaacattgcgcagcagtcaaggccttggcatggtgccccttccagaccaatcttttggcatctggtggagggacttcagatggttctataaagttttggaacactcaaacaggtgcctgcctgaataccgtcgacacccattcccaggtctgttcattgttgtggaatagacatgagcgtgagttattgagttcccatgggctaaatcagaaccagttaaccttatggaaatacccatccatggtgaaaattactgaacttacagggcatactgctagagttcttcatatggcacagagtcctgatgggtacacagttgcatcagctgcagcagatgaaacactcaagttttggcaagtttttggggctcctgatgcctcaaagaagactaagactaaagatacaaaaggggctttcaacatgtttcatatgcacatccgctaagaagtatctgtcaaatttcatggaatcaggatggatgttcaactgaagaggggctttcagcaagtttcacgctcacatccgctaagtatttgtccagattcatggaatcagagcggatgttcaactcaaggtagtaattagatgttttattttctgcttgcaaaggtcttttgcaggcgctctatagttctgttctctagcatgaagtgtgtattttatctattgtggaccttgatggaatgatgtcgcaacagccttgtgagacaatgatccatttcttcagctgcgtgataagatttaaagtggttttagcaagtctttggagcttcaaagacggttccaaaaatgatactttatggctgttagcaagcatctgattcacaactataaaaaggcctccatgcttctacacatggaatgataatgaggggatgctcaatgttgcagaagatcgttcaaggtgcctttaacgaacatgggatcttgccaaggtgcctttaaggaacatgggatcttgccagcattctaagatgttcgagaatgggttcatacagagaagagcagcatggtttgtcaattgcatttttttaatatcaagatcttaatgtacgctcttttgttatccattctgtacttagctagttgcactacaattttccagcaaaaaaaaaa

SEQ ID NO: 229 - DNA, 1717 bp, Pinus radiata
tgagttttcaagcaactgttaggccttatacttatgttgggtgccggagtctagtggagttattttggcgagatacaggggaagagcgcaaaaacaagttaggcggcactgtgatggtgtggtggctgtatgcaagacactagaagaagaagaagatcgagagaggagagcaacggcaacgagaatgctagacgaaattgtggcagacgaggaggaggaattcaacatatggaagaagaacaccccccttttatacgatgtagtgataacgcatgcgctggaatggccttccctcacggtacagtggctccccgaccgccaccaatctcccacaaaggactactctctgcagaaaatgatagtgggcactcatacatccggggacgagcccaattatttgatgatagcagaggtccagatgcccctgcaatactctgaagacggtaacgttggaggttttgaatccaccgaagccaaggtacacataatccagcagattaatcatgaaggagaagttaatagggctcaatacatgccacagaactcatttattattgcaaccaagacagtgagctcagatgtttatgtgtttgattacactaagcattcatcaaatgcccctcaagaaagggtttgcaatcctgaattgatattgaagggtcatactaatgaaggatacagtttgtcctggagccctctcaaagaaggtcaactactaagtggttcaaatgatgcgcaaatatgcttctgggacattaatgctgcatctggcaggaaagtggttgaggccaagcaaatatttaaggtccatgagggggcagttgaggatgtttcgtggcatttgaaacatgaatatctttttggatctgttggagatgattgtcatttgcttatatgggacacacgtacggctgcacctaacaagcctcaacattcagttgtagctcatgagagtgaggttaactctttggcttttaatcccttcaatgagtggcttttagcaacaggatcagcggacaaaactgttaaattatttgatctccggaaactctcttgttcactacatacattttcaaatcatacggaagaagtctttcaaatagagtggagtcctatgaatgagacaatattagcttcgtctggtggtgacagaagactcatggtttgggacctcagaagaattggcgacgagcaaacatcagaagatgcagaagatggaccacctgaattgattttcattcatggagggcacacaagcaagatatctgatttctcatggaatctccatgatgattggttaattgctagtgtagcagaagataatattttacaaatttggcagatggcagaaaatatttaccatgatgatgcggatattctatgatgaaatttcataactcttacctactatggttggtgtgccttggagaaaatttccaatgccttcatgggtgtgtaatccatgataattacaggaacattgtggatcaaatattgtaatttgtctttaatcttcagggttcgttactaacaattgagctcaaatctctattctgaccagcaatccagaagttggatgcattaaatataaggtggattttagtaccttaagttaatgtattttataaaattatgaagcactctggacatctgctctgttcatcaaggcagacatcacaaggaagtagaaattgaagttatgtttcaaaaaaaaaaa

SEQ ID NO: 230 - DNA, 1892 bp, Pinus radiata
cacaagcacagcagtgtgcgttaaagaaagggcggtttgtattgtataaatggtaaatccgagcgcagaggatggaatggctacaggtatttatgcagtatgcagtgaacagagatggcaggctggccgtgatatttttgtgtttataccacatggtctgagggcgattgattttgtcagctgatatctctcagggccctgagcctgcctccctgcctggccgcctgtgtatgaatatcaatgacgaaagaagatcatggggagtcgagggatgagatgggggaaagaatggtgaatgaggaatacaaattatggaaaaagaacaccccattcctgtacgatttggtcatcacgcatgctctggagtggccttctttaactgttcaatggctgcctcccagctgcaagcagcaacaggacattatcaaggatgatgacattgatcatcccaacacccaaatggttattctcggtacccatacatcagataacgaacccaactatctaattttagctgaggtccagctccatgatggaactgaggatgaagatggcgatggcgatgtcaaacggccccaggataaaatgaaaccgggaacctctggaggtgcaatggggaaggttcgaatacttcagcagataaaccatcagaaggaagtgaaccgggcgagatacatgcctcaaaaacccacaatcattgcaacaaagactgtgaatgcggatgtttatgtcttcgattacagtaaacacccgtccaagcctccccaggagggacgttgcaatccggaactgcggcttcaaggtcacgagtctgaaggctatggcttgtcttggagccctctcaaggaaggtcatctgttgagtgcttcagatgatgcccaaatttgcctctgggacatcactgctgcgaccaaagcccccaaggtggtggaagccaaccaaatatttcggtaccacgatggaccagtggaggatgtagcatggcacgcaattcatgatcatctttttgggtctgtaggggatgaccatcatttgcttctatgggatatcaggaacgactctgagaagccacttcatattgttgaagctcaccaagctgaggttaactgtttggctttcaatcctttcaatgaatggattgtggctacaggctctgcagacagaactgttgcactccatgacattcgcaagctggacaaagttcttcatacttgtgcacaccacatggaagaagtgttccaaattggttggagtccccaaaatggagctatattagcatcatgtggatcggatagacgactcatggtttgggacctcagtagaattggcgatgagcaaaatccagaggatgctgaggaggcacctcctgaactgctattcatacatggaggacataccagcaagatttcagacttttcatggaatccagctgaggaatgggtaattgccagtgttgctgaagacaacattcttcaagtttggcagatgtcagagcacatttacaatgatgacaatgattcaccaacagcttaataggtttgttgctgtttggaccagctaattgattgtttacaggacctcggaaaaatgtggagcctctttatgccatattccatggcacagggttgaagaagcctgaatatcagcagaaagcgagcttgtatattgcagcgatgttaatgattctcttttataagagggaaaaagtttataagcacttgtgaaaattgtcttggacgtttaatttctcttgtgaaagtatggagcttctcatcatttatagagttgtgcaaaatcacccataatgctatgaattgacaggtgactgtaatcttacaattttctgatgcaatttgaagatggattatgcaagtcttttatcaaaaaaaaaa

SEQ ID NO: 231 - DNA, 1692 bp, Pinus radiata
ttagtagaagtcaggcttagcttaatagtagcggaaataggagctaaactgtgagacccgccggttagtatgcagataccacttagggattccacttacgagtccattggggttattttggcgggagacagtcgaagagcacaaaatcgaaaacaagtggtatattgtggctctgcaatggtgtgtgcaatagaatagagaagaaaaatagcagaagtcagaggaaagcatggcgatggcaatgggagacgaaaatgcggccgatccagttgaagaattcaacatatggaagaagaacacacccttcttatacgatctagtgataactcatgcgctggaatggccttccctcactgttcagtggctccccgaccgccaccaatcatccacggcggactactccctgcagaaaatgatagtgggtactcatacttcagaggacgagcccaattatttgatgatagcagaggtccagattcccctgcaaaactctgaagataatatcattggaggttttgaatccaccgaagctaaggtacaaataatccagaagattaatcatgaaggagaagttaacaaggctcgctacatgccacagaattcatttgtcattgcaacgaagacagtgagctcagatgtttatgtgtttgattacagcaagcatccatcaaaggctcctcaagaaagggtttgcaatcctgaattgatattgaaaggtcattctaatgaaggatatggtttgtcatggagccctctcaaagaaggttacctactaagtggttcaaacgatgcacaaatatgtttgtgggatataaacgctgcatttggaaagaaagtgcttgaggccaatcaaatatttaaggtccatgagggggcagttggggatgtttcatggcatttgaagcacgaatacctttttggctctgttggagatgattgccatttgctcatatgggacatgcgtacagctgcacctaacaagcctcaacaatcagttatagctcatcagagtgaggttaactctttggcctttaatccgttcaatgagtggctgttggcaacagggtcaatggacaaaactgtcaaattatttgatcttcggaaactcagttgttcgttacatacattttccaatcatacggaccaagtctttcaaatagagtggagtccgatgaatgagacaatattagcttcttctggtgctgacagaagactcatggtttgggaccttgcaagaattggcgaaacaccagaagatgaggaagatgggccacctgagttgctttttgttcatggagggcacactagcaagatatcggatttctcatggaatttgaatgatgatcgggtaattgctagtgtagcagaagataacattttgcaaatttggcagatggcagaaaatatttaccatgatgatgaggatatgctttgaagaaatttcataattcctacctactatcgttggttttctgtggagaaaatttcctatccctttgtgggtgtgtgaaaaacgaaatatagaggaacaatgtggataatgcattgtaattcatttttgtattgaagaacaattaatctcaaatctttatctccaatgattctctattttctgtccggattaagtataaggcagatttcagtatataaggtcaatgtatttataaaagtatgaaacagactggacatttg

SEQ ID NO: 232 - DNA, 3222 bp, Pinus radiata
caggaaacctttaccacgaccaactccagccagctaacaatttccgactgtgtacacggacacaaagtttattgcaaatatcttcccacgatctgtagagatgggattgtttgagcccttcagagcactgggatacatcactgatggcgttccattcgctgttcaaaggcgtgggattgagacttttgttaccctgagcgttggaaaagcttggcaaatttataattgtgccaagctgattccagtccttgtaggacctcaaatggataaaaagataagagcacttgcatgttggcgagattttacatttgctgccactgggcatgacattgcagtgtttaggcgagctcatcaggtggctacatggagtggacacaaggcaaaagttacattgcttctttcttttgggcaacatgttttaagtgttgacttagaaggatgcctttttatatgggctgttgcagaagtgaatcaaaacaaaccaccaattggacaaatacaacttggggagaagttttctccaagttgtatcatgcatccagacacttacctaaacaaggtccttattgggagtgaagaaggtaccttgcaactttggaatgtgaatacacgtaaaaagctttatgagtttaagggctgggggtcttccattcgatgctgcgtctcatctccagctctagatgtggttggaattggttgctcagatggcaaaatccatgtccataatctacgatatgacgaagagatagtgacatttatgcattcaacaagaggggctgttactgctttgtctttcaggacagatgggcaacctcttttagcagctggaggttcctctggggtgataagtatatggaaccttgaaaagaaaaagttgcagtctgtaataaaagatgctcatgattcttcagtatgttctcttcatttttttgcaaatgaacctgttctgatgagttctgcaacagataattcaatcaagatgtggatctttgacacaactgatggagaagcgcgactcttaaagtacagaagtggccatagtgcacctcctatgtgtataaggtattatggtaaagggcggcatattttatctgctggacaagatcgagctttccggattttctctgttatacaggatcaacaaagtagagaactttcacagggtcatgttggaaaacgagcaaagaaattaaaagtgaaggatgaagaaatcaaactgcctccagtcattgcttttgatgcagctgagattcgtgaaagagactggtgcaatgttgtcacctgccatttggatgatccttgtgcatacacatggcgtcttcagaactttgtaattggtgaacatattttgaagccatgtttggaggatccaacaccagtgaagtcttgcagtatcagtgcatgcggcaattttgcagtgcttggaacagaaggagggtggcttgagcggtttaatcttcaatcggggattagtcgagggacatatattgatataggagaaaaacgacaatgtgcacacaatggagcagtggttggtctggcatgtgatgctacaaatacccttttaataagtggaggctataacggagacattaaggtttgggatttcaaggggcgtgagctaaagttccgatgggaaattgaggtcccattaattaagatcgtatatcacccaggaaatggtattctagcaactgcagcagatgatatgattcttcgtttattcgatgtcactgccatgcgacttgtgcgcatatttgttgggcacatggaccgtgtcactgatttgtgttttagtggagatgggaagtggttgttgtcatctagtatggatgggaccataagagtttgggatataatttcatccaggcaactcaatgcaatgcacatggattcagctgtaacggctttgtcattgtcaccgggtatggatatgctggcaactactcatgttggtcacaatggcatctatctctgggcaaatcggatgatatattcaaaggctactgacattgagccctttataagtgggaagcaagttgtgaaggtttctatgccaactgtctcatccaaaagagaatcggaggaaggggatgagaaaagaacaattgttgcagaatcaaatgtcaataagtctgatgtttctggtagcttgattggggattcatattcagctcaacttacgcctgaacttgtgacgcttgcactgctgcctaaagctcagtggcaaagtcttgtcaatttagatattataaagatgcgaaataagcccattgaaccacccaagaagccagagaaagctcctttcttcttgccatcattgcctacactctctggagagaggatttttatccctagctctatgaatggggatggtgatcaagatgaaacaagaaatgataaaactgtttttgaagcaaggggtaaaaaactgggaggagaatctttatcatttatgcaacttctacaatcctgcgcaaagatcaaagattttacaactttcacaaattatttgaagggtttatccccctcagccgtggatatggaattgcggttgcttcaaattgtcgataatgaaaatatatcagaaacagaacacagtgtagaacttcaagggataggaatgctgctggattactttgtaaatgaggtgtcatgcaataataattttgagtttgtccaggctttgattcgactatttttaaagatacacggtgaaaccattcgatgccaagtatctttgcaggagaaggcaaggaagctacttgagatccaaagttctacatgggagaggctagatacaagcttccaaaatgcgagatgtatgattacatttcttagcagttctcagttttgaccaatcatttatttgcagtgtagttgatatgaagggagaaatatgacagttggtttcaacctgcttgcctatccctccaaagaatatatagtgtaaattgtctgttgcaatagggatggagcactaagtgcttactatggcaaatgctatcaatttttgagggcttgtaatggcattatttccttgagttgttcttgtaggttgttgagttaccagttttgatcctttgatcttttgttggttagctgaggctaatggcgaggccatgtttttcagttaatgtaaaatatgatatcttgtgtatcatgtgacacatttcaattcagttattggcttgcaacttctaattacactcaaaaaaaaaa

SEQ ID NO: 233 - DNA, 1802 bp, Pinus radiata
cgaggacgtatcgatcaaaaaatctctatcataaggtgcagaatgattgcagcagtgtgttgggttcctaagggtgttgcaaaggtcctaccagattctgctgaaccgcctactcaagaggagattcaagagttattgaagtgtaacgttgtagcagagagtgatgataatgaagatagtgatgaagaaagtgaagagatggatactgaaactgataaaaataccgacgcagtggcaaaggcattagcagcagcaaatgctcttgggagtcagtcttcagattttcaaaggcagcacaaggttgatgatattgctaatggcctcaaagaacttgacatggatcattatgacgacgaggatgaaggcattgacatttttggaagtggttctcttggtaattgttactacccagccaatgacatggacccttatcttgtagaacaagatgatgatgatgaagatgaaatcgaagacatgacaattaaaccttctgacttgattatcttatcagctcgtaatgaagacgatgttagccatcttgaggtctggatatatgaagaagaaactgaagagggtggttccaatatgtatgttcatcatgatatcatcttgccagcctttccactttctcttgcttggcttgattgtaatctgaaaggtggagaaaaaggaaattttgttgctgttggaacaatgcaacctgaaattgagctctgggaccttgatgtacttgatgaggttgaacctgctgtagtcctgggtggtgctgttaaagatgaagcatctggtaagacgaccaaactgaagaaaaagaagaaaaataaacaggctgtcaattttaaagagggaagccatacggatgcggttcttggtttggcatggaatatggagtacaggaatgtcttggctagtgcaagtgctgacaaatctgtaaagatctgggatattgttgctgagaaatgtgagcacacaatgcaacctcacacagataaggttcaagcagtagcctggaatcctaatcaggcaacagttcttctcagtggatcttttgatcgttctgtgatcatgatggacatgagggctcccacacactcagggatacggtggccagttccagcagatgtagaaagccttgcatgggatcctcatactgatcactcatttatggttagcgctgaagatggcactgttcgaggttttgatattcgtgcagcagcatctactgcagattttgatggcaagccaatgttcatacttcatgcacatgacaaggctgtctgcgcaatttcatacaaccctgctgccccaagtttactcacaacaggatcaacagataagatggtaaagttgtgggatataacaaataatcagccttcatgcattgcctcaacaaatccaaatgttggagctgtgttttctgcagctttttcaaaaaacagtccgttcttacttgctactggaggctcaaagggaattttgcatgtttgggataccctagataattctgaagtcgcgagaagatttggaaagttcagaccacagaattgaactttcatatttctattcagttttgttcgaagaataatatcgataaaatttattttcatattctccagaggtgggattgtgtattataatgtgttaatacttggtcatttatttgcggcttttgttggcacattgttgtgcacattgctaaatttctacgagccttcggggacaagtgtctaactgtcccatcagtaacatttctcgaagttttgctaaaagttaatgttctcataggttattcaaaaaaaaaa

SEQ ID NO: 234 - DNA, 2197 bp, Pinus radiata
ccaaattcccgcaatctcacatttgaaacctgtgctgccctccattttatgatctcaattcaactcgagtctaacctgagccaaactcgatctctgcgcataaaaaactagattctccgggtttcattaccctttcctcgggcataaattcatttgggtatttgaatattcacctaggtattcaacatttctattgggtagtaaaatgattatggatgagaacgagttctgtgatattttctccctgagaaaaaggctatgcctgctgtcttcccaggagggggaggaagaagaagaattagaggcaatgtcacagctcgatgccggagaattcaccgtgacaggcaatgaagaggtagttgccattgccgaagatgatgtaaacactggaatcctcagtcaggatcttttcagttcacaagactattgtacaccatcccaaccacaggattcgaccgatttggatagcaaggataaggctccatgcccactatctcctgtgaaaagcacgattcagagaaagaggtgtagaccagagctcctaagtaatccacctgatagcatccagttctcctttcaacgattggaaagagttagaagtgaagaatctatccagtcctcctctcaacaattagcaagagttagaagtgaagtatctagttcagatgatttcaaaactccaaaaataaccgcatctggtcaaaagaattatgtctcacagtcggcattggctctacgggctcgtgtcatgtcaccaccttgcattaagaatccatatttagatgaaaatgaagagttaaatgaaaagattcaaagaagcactcgtcgatctcccgcttgtgtaactcctatccaaagtggagcctgtttgtcccggtatcgtgcagattttcatgagctagaggaaattggtcgtggaaatttcagtcgtgtttacaaagctctgaatagacttgatggctgctgttatgcagtgaagtgttcacaaagcgagttacgacttgacactgaaagaaaggtggcattgatggaagttcaatcgctggcagccctaggaccgcacaaaaatattgtgggatatcacactgcctggtttgagaatgatcatttgtacattcaaatggagctttgtgaccataatctaacaactgcaaatgacagaggaattctaagaacagacacggactttcttgaagcagtgtatcaaattgctcaggcattggagtttatccacgggcgtggagttgcacatctagatgtcaaacccgagaatatttatgttcgtgatggtacttacaagcttggagactttggtcgtgctacacttattaatggaacactccatgtcgaagaaggagatgcacggtatatgtcccgtgaaatcctgaatgataattatgaacatcttgacaaggtggacatgttctcattgggtgcgaccttttttgaacttttgatgagaaagcaataccctggttctggcaaacggatagacagggacacagaaattaagatcccaattctccctggtttttctatatattttcaaaagcttctacaggatttggtcagcaatgatccgggaaaaagaccatctgctaaagatgtactcaaaaatcctatatttaataaggttcggggagcaaaggaagtctaaggatatggacgaaggatgaattaattttgaaaattttgacaattctgcaggatggatacttttgtcaagatacatgcaaaattcactttcctcgtggaacgaggatcgactttggtgctatacggaggacttgcgataatgcaaaacttatagctgttacttaaggatttcattgcaactaaaaatctttggctgtaaacaatcaagtaatgatagatgtgatatgctggagatttatattttggacggaagagtggagttattagtttgcaatatttttgttaaatatgcatggtgaacaggcaagatcactgtgcttcctcataaattgaggcttgcctacgttaattgttatatatggagagccatgctaattgttatatatgggaagctctatcccaattgtaattttgtaattttcaatcaccttctttggtggtatttcagttcttgctgtaatcacgaccttctgtgctgatacagtttattaatcaaatgtaatcatcaccttctgtagtgatgttcatgttaaaaaaaaaa

SEQ ID NO: 235 - DNA, 1694 bp, Eucalyptus sp.
gctttgcttccagcacagtgcagaggggcaacgcagcacaaagctgaaccgccaaaaccctaataagcatttccaagccaccgtccaccggaggatcggagcggcaaagcaggtcgatgctggcgccggcgctggagatggagccggtggagccgcagtccctgaagaagctcagcttcaagtccctcaagcgcgccctcgacctcttctcccccgtccacggccagatcgctcctcccgaccccgagagcaagaagatgcgcatcagctacaagcttaatttcgagtacggtggaggtagcgggagtgaggaccaggttccaaagcggaaggagagcggcgccgcgcagaatcaaggccaacaagctgccggggcttccaatgcgcttgctcttccgggtccagaaggttctaaaattccaccaatggaaaagtctcaaaatgctttaactgttggtccatcattacgacctcaaggattaaatgatgttggtctacatggaaaaggcactgctattatctctgcttctggatcatcagacaggaatttgtctacctcagccattatggaaagacttccaagcaggtggccacgtcctgtgtggcatcctccatggaagaactacagggtcataagtgggcatttgggatgggtgagatctattgcatttgatcctagcaatcaatggttctgcactggctctgcagatcggacaattaagatatgggatctagcaagcggaaggctgaagctaacactgacaggacatattgaacagattaggggccttgcagtgagtagtaagcatacttatatgttctctgctggtgatgacaaacaagttaaatgctgggatcttgagcagaataaggttatccggtcttatcatggtcatcttagtggtgtttactgcttggctcttcatcctactattgacattttgctcactggaggacgtgattctgtctgtcgggtatgggacatccggagtaaaatgcaaatttttgcactctctggacatgataatacagtttgttcggtcttcgctcgacctacggatccacaagttgtaactggctcccatgatacaactatcaagttctgggaccttagacatggaaaaacaatgacaactctcactaaccataagaaatctgtgcgagcaatggcccagcatcctaaggagaactgtttcgcatctgcatcagctgataacatcaagaaattccagcttcctcgaggggaatttctccacaacatgctctcacagcagaaaaccataatcaacacaatggcagtcaatgaagaaggtgtgatggctactggaggtgacaatgggagcttatggttctgggactggaagagtggccacaacttccagcaagctcatacgattgtacagcctggatccttggagagcgaagctggaatatatgctctctcctatgacttaactggttcacggctggtgtcatgtgaagcggacaagaccataaaaatgtggaaagaggatgaacttgctaccccagaaactcaccctctcaatttcaagcctcccaaagatatcaggcggttctagttctttgtaggcatcctattgcaatcttatgtcaccgcttggcaacaccgtccatcctttcacgcagcctgtttgctccaacagatcttcttgcatctactcttcttcggaaga

SEQ ID NO: 236 - DNA, 1982 bp, Eucalyptus sp.
gcagcagaagagagagagagagagaaacgcgatcgttcctcagtttcgtcggagtgaagaaggagatcggatcggaggctcgccggcgaggagaggggaagacatcggacatggaagaggccgccaaggaacaatccgccggttccgggaagccgaagctgctccgctacgggctgcgatcggccgcgaagccgaaggaggacaagaaggaggagcagctccaccagccgccgccgccgccgccgccgcagcagcaggcggctccggcgccggcaccggcggccaccaggtcgtcgacgtcggggtcggcggggggccgggaccggaggccgcagcagcagcacgcggtcgacgagaagtacgcgcggtggaagtccctcgtcccagtcctctacgactggctcgccaaccacaacctcctctggccttctctctcttgccggtggggcccgcaactcgagcaagcgacttataagaatcggcagcggctctacatttctgagcagactgatggcagtgttccaaatactttggtgatagcaaactgtgaagttgtgaaacctagagttgcagctgcagagcacgtgtcccagtttaatgaggaagctcgctctcccttcataaggaagtacaagacaattatacatcctggagaggttaacagaatcagggaacttcctcagaatcccaatattgtggcaactcacactgacagcccagatgttctcatttgggatgtggaatctcagcctaaccggcatgctgtctatggagctacagcttctcgtccaaatctgattttaactggacatcaagagaatgctgaatttgcccttgcaatgtgtccagctgaaccctttgttctctctggagggaaggataagacggtggttttgtggagtatccaagaccatataacagcatctgcaacagatcaaacaactaataaatctccaggatctggaggatccatcattaagaagactggggaaggtaatgaggaaactggaaatggcccttctgttggaccacgaggaatctactgtggacatgaggatactgttgaagatgtggctttttgtccatccactgcacaggaattttgtagcgttggtgatgattcatgccttatattgtgggatgcacgaattgggactaatcccgttgctaaggtcgagaaggcacataatggtgacctccattgtgtggattggaatccccatgacaacaacctaatcttaaccgggtcggcagataactctgttaacatgtttgatcggcgaaatctcacttctaatggagttggttcaccagtctacaagtttgaggggcataaggcagctgttctttgtgtgcagtggtctccagacaagccttccgtctttgggagttctgctgaagacggtctcttgaacatttgggattatgagagggttgataaaaaggttgacagggctccaaatgctcctgcgggattgtttttccagcatgctggtcacagggacaaaattgtcgacttccactggaacacagctgatccatggactatggttagcgtatctgatgactgtgatactgctggaggaggtggtacattgcagatatggcgaatgagcgatctgatctacaggccggaagaagaggttttggctgagctggagaatttcaaggcgcatgtactggaatgctcgaaggcatgagagtgcctcgagaacaggccttccgggtctcaaacactaactagacaaagcgggtttttgctggctgttactgctgtaaaatctgtaggtacttagccatggtttagactcatctgtgagcgccaggactcccctctttacgcagatggtgactgaagctggttccgagatcggcatatgtagctggtagaggtgtggatattgcatagaccgaacctccgcaggtccgcattctcgagtgagaaacagagataaattttaagggggttaccaaaaaaaaaa

SEQ ID NO: 237 - DNA, 2022 bp, Pinus radiata
tctttcactgcatgctccctttcccgcaaaacacaaaccaaacacgttaaactctaacccaaaccttctcgcaattcttaccaaatccagttactctgagccaaaacccttggcgggaaaaccccagttaggagcttccggccatggcgaaggacgaagaagaattccgcggcgagatggaggagcgcctggtgaacgaagagtacaaaatctggaagaaaaatacgccgtttctttacgatctggtgataacgcacgccctcgaatggccttcactcactgtacagtggctcccggaccgcgaagagccccctggaaaagattattccgttcagaaaatgatactggggactcatacttccgacaacgagcccaactatctgatgctggcccaagttcaactcccgctagaggatgcagagaatgacgccaggcagtatgacgacgagcgcggggagattggagggttcggctgcgccaatggcaaggtacaagtaatacagcaaataaatcacgatggagaggtcaatagagcccgatacatgccacaaaatcctttcattattgccacgaaaacagttagtgcagaagtctatgtgtttgactacagcaagcatccttcaaagcctcctcaagatggtggatgtcatcctgatctcagattgaggggtcataatacagaaggttatggtttatcatggagcccttttaagcatggccatcttttaagtggttcagacgatgcacagatctgtttgtgggacattaatgtacctgccaaaaacaaagtgcttgaggcccaacaaatatttaaggtgcacgagggtgttgtagaagatgttgcatggcatttaaggcatgagtacctttttgggtctgttggagatgaccgccatttgttgatatgggatttgcgtacatctgcaactaataaaccactgcactcagtagtagctcatcaaggtgaggttaactgtcttgcattcaatcctttcaatgagtgggtactggctacaggatccgcagacagaacggtgaaactttttgatctgcgcaagatatccagtgctttgcataccttttcctgtcacaaggaagaggttttccaaataggctggagccccaaaaatgaaacaatattggcttcttgtagtgcagacagaaggcttatggtgtgggacctcagcaggattgacgaattccaaacaccagaggatgctttagatggaccacctgagttgctgtttattcatggtggacatactagtaagatatcagatttctcatggaatccatgtgaggattgggttatagctagtgtagctgaagataacattctccaaatctggcaaatggctgaaaatatataccatgacgaggaggacgatatgcctcctgaagaagtagtgtaacttttatctagctagaagttgtgaaattaagagggatgtgaggattgggttataactagtgtagctgaagataacattctccaaatctggcaaatggctgaaaatgtatatcatggtgagggggatatggcttccaaagaaacattgtaagagctagctagaatttgtgaaattaagaggtgtattcactttcagagtttctcaacaaatgacatggttctcattccattttcttttatataatgagaagcaaaacttggcttatcatcttttttattgagaaaagacacattgaaagagcttaaacctttagcttttgctgttttctgctgtatttatgtagtttgcaatctggtgaagattatgccaggtctgcctttccttgtaatagtttttatagacaaatttatagctgaaagtgatgcccacgttctaggtaagatgggaaacatcagaatgtaagggtctcaaatgttgtcactattcaattttcatctatttctggtctggtggattttgctggtaagacatttgaagatgtccaacacttgttctacagtgtattgtgaaatataagcacataacttgatacaaaaaaaaaaaaaaaaaa

SEQ ID NO: 238 - DNA, 2029 bp, Pinus radiata
gcctaactccccaccacacaaaaacacaaacaggcagagtcccccgcaactctcctgtcctgtttccattaatctcttacgccgttgcgttttcccttctgatcagccctcccattctgctcccctccgttcctgcccttgggttgagaaaggccgttgtggccatttgtcagtgtctgttatttttgtttgagccggcacagcaatctgccagtctctatctgtaactcactcggtttttcttgaaacagcaggaatcaccgtcaccaagaagacgccattgcagtgtgtactcgacttctgcaagatagctggtcagtcaaatcaaatttacaccgacgagcactcggaaatagtttcttttcctccaaattttaatgcaaatttttcgactgcgaaaaaaaaaaatttggcttgaattctggtttttcagcaaggaggtttttttcctctggtttaacagcagcagcaggatagggaaatattttgtgagtacagtttctgaaaaaacattcggacaaatttttgtctgcgagggttcgaggaatctcgaaattttcacaagctgttttgggtttctgggcaaattttagggcaaatgttttaagaatgagaaatccaaaccgtgtgctcgtgcatagcaaggaaaaaaaaattattctgtagagtatcaggaaaaatcagcagctctcgcgaattcgtctttttctcttccttttttttttgaacttggcatgcagtgtgggcttagaacagtgcgtttcaaccgtggctccttaccgtggttcaaaaatggggaaatacatgagaaaagggaaaggcgtaggcgaggtagctgtgatggaggtctcgcagggctcgctcggtgtgagaacgagggctcggacgcttgcagcagcttcttcacagaaagaccaccggcgcctcggtgcctccaaatctgtgactacgaaacaccagagctcggcgcctcctgcttcaccatgtgtggagtcctccatgcacacatgctaccttgagctacgaagtagaaagctggagaaattttccaggtgttaccacagcgcccatggagcaacaagccacggggagtccaagaggagcttgagcttgagcgaaccttcgaggctggcagtttcagaggaggcgagagtggccagcgacaaaagtagtcatagagtcctccaacaacagtcttccgtggctcattccaggaacaattctgcaacgttttctcacaatgccaagccggccaaagcagcccaaaggaaggagcgccgtgacgacgaccatacgtcggcgcggccatccgaagctccccatgaggacgaggatggcatggaggtagaggcatcatttggggagaacgtaatggatctcgactcgagggaaagaagaactagagaaacgacgccatcgagctacacaagggacgtggagacgatggaaaccccggggtccacgactaggcctccctctaacgccggcagaagaagattccagaccgaaggggggcatggcactcgcaaccaatttcacgttcccaccaccaacgaaattgaagaattcttcgccggtgcagagcagcaagaacaaagacgatttacagataggtacaattatgacccagtaagtgactcgcctttgcctggtaggtttgagtgggttagattgaggccataaatatctttcacaaataattgtggggctgcaggcagttggtgtggttgggagtgctttaccagcccttgccattcttctgtactgctctgttaccaatttaacttggggtttcaacggaactcaaagaaaaaggaaaactgtaactgccacaaggccatgtttgatgccaaactgcatctctcattatttagggtgcaggctgtataaaatgttgtaaattgtagtatcaatgtgtacaatatgaagcggctggcatggcttcttccctacaatgtattttgcaggggcattcttcttttttattcccaatgaaaaaaattcaaacaaaaaaaaaaaaaaaaaaaaa

SEQ ID NO: 239 - DNA, 2439 bp, Pinus radiata
accgaatgaacccatcctgcgcgcggatatctgcatttgatgcaaaggagaagagggcgagggtgttaaggagggcggagttgctgtagaggagggtcggttcggtcataactcctgaatttcttgttagtgtttgatgtataaggctgctcagatgttaaatatatttgattcggtttgttttgaaggcaaatgaaactcttcgggcttatgaaggttggtttgaattgagaaatttgggatatataaacagtggccatgttctccggaccatggaattggggatttctccatagggttttagtgtttcagggttttgagacttgaataccttgaaaagatttgatgggaaggttttgagagataaaatctcgaaaagattttatgggaacaggtcttccggagatttgaggaatgcaaaacatggaggaaaatgtgcagagcagctggagtctccacggcaacaaagaaatatgtgcccgttacgagattctaaagagggtcagcagcggaacttatttggatgtgtacagagggcggagaaaggaggatggtctaatagtagcccttaaggaggtgcatgactatcaaagctcttggagagagattgaggcgctgcaaaggctttgtgggtgccccaatgttgtgaggctctatgagtgattttggagtttctgacttccgatctctattctgtcattaagtctgctaagaataagggagaaaatggtattcctgaggccgaggttaaggcctggatgattcagatcttgcaagggttggctaactgccatgccaattgggttatccatcgtgacctaaagccctctaatatgctcatttcggcttatggaattctcaagctcgctgattttggataggtaagtatagatgatttagtggcttgccatctgttgcatcttctgtgttttttttcttgtcaccttcaatcctctagctctgtttgaccctatttcttgaagtgttcgtacattctgttctatttcccatttcatgtttttaatattttaaaatatgctgaaaccctgtttatggttaactacatcttcgtagtagttcaaaatgttaacaaatctcatacttgaaaagttcaatctaaaatcttgaaaattttgactgattcaaagcgctttggaaactagataaatgaattgattttgccttttactataactattcgagcaaatgttgcatagaagcgcaaggttaatagtttcccaaattgaaactgaatagtgcttaaagtttagtgattctccgtcagtaggatgcctgaacattcaataacttagtgatctctgaattcgaaaatcaatatttgcaggcaaggatacttgaagagcctgaagcgatctatgaagtagagtatgagcttcctcaagagggcgatctatgaagtagagtatgagcttcctcaagaggatatccttgctgatgccccaggagaaaggttgatggatgaagatgatagtgttaagggagtatggaatgaaggggaggaggattcatccactgcagttgaaactaattttgatgatatggcagaaactgcgaatttggatttgagctggaaaaatgaaggtgatatggtgatgcagggattcacatctggtgttggaactcgatggtacagagctccggattttctctatggagcaacgatctatggaaaagaaattgatttgtggtcgttaggttgcattctgggggagctcttgattttagaacctctcttttctgggacttcgaacattgatcaacttagcaggctggttaaagttcttaggactccaacagaaaaaaaattggcctggatgctccaatcttcctgattataggaaactttgttttcctggtgatggaagccctgttggtctgaagaaccatgtccccaattgctcagacaacatgttttctattttggaaagacttgtttgctatgaccctgcagctaggctaaatgctaaagagatagttgagaataagtattttgttgaggatccttatcctgtcctcacccatgaattgagagttccctcacctctaagggaagaaaacaatttttcagaggattgggcgaaatggaaggatatggaagtagattccgacttggaaaacattgatgagttcaatgtcgttcactcaagtgatggtttctgcattaaattttcataaactctaattggttgatcatgtttcatcttcctcaaattgccttttatatggattagtattctaaattagctttgggggctgcatgtcttcaagcattcaccacgacagtaaagtaatcattatgattactaatgtattgctttcatggggtgagaaacattatagccatgaacctactgttaaatttgtagaattgtcttatacttgctcaaaatagtgactgcatgtttgagaaaaaaaaaa

SEQ ID NO: 240 - DNA, 2189 bp, Pinus radiata
actccaacagaggaaacaaaaacacatttcccgccttcgcatttccatttatatctcaataccagttctccgacattttatcggccttcaaatctctgataagaaataatggctcccgtcaagaggatcgaaccagagaaaacgaaggctaacgaaggcaagccgaagcgccggaaagtagccttcgccatagacacaggaattgaagcaaatgactgcatatcacttcatcttgtgagcaccccagaggaaatgcgagatgcagagggagtggaggatcaaagcttatcattcaacccagaatatatgcaacattttgttggggaacatgggaagatctatggctacaaaggcctgaaaattgatgtgtggctgaatgccctctcatttcatgcctatgtggatatccagtatgagagcaaagttgaggaaggaaagagcgagaaagaagcaacagacttgacagatattatgaagagaatatttggacgtggcttggtggaagatcgtaatgcctttatccagagtttttcaagtaacagtcaatctatcgaaagtatgatccacaatgaaggtgagcgtatagcaacacgtgagattttgactgataagggtctatctgcgcaaggagattcagagagattgggagtctcaaacgagatattccgccttgaattgagcgatccacagatacgagaatggcatgcacgcttggaaccgcttgtgcttcttttcgttgaaggaagccaacctatagagcaagatgacccaaaatgggaaatgtatatcagggtccagagggagtcattgagtggaggcagtgctgtgtgtagattattgggattctgtactgtttaccgtttctatcattatccagacaccacccgtctaagaattagccagatactagttttccctccttatcaaggtaaagggcacggcttacttcttttagaggctgtaaataaaactgcagtttcgagggattcttatgatgtaacagtagaagaaccatccgagtccctccaggaattacgcgattgcatggatacaatacgcctcctttcttttgaacctgtaatgcctgcagttaagtcagcggtgcagaagttgaaggaagcaaacccctcagacaaaggtgcagctgatcactgtttagaaggaaatgtaaacaatgagactgtgactacctccagcacaaaacccaaaaataaaagtgggtggtttccacctccaggtctagttgaagaagtgaggaaacatttgaagattagtaagaagcagttcaaacgatgctgggagattcttctatatttgaatttggaccgctctgattcacaatgtgaggataaatatcacatctctctcatggaacagataatgtcagaactctttgataaatcgagcgagaagagtgccaagggtaaacgtgtgattgatatagataacgagtatgacaattcaaagacgtttatcatggtccgcacaaggaatccaggcaatggtgaaggttttttacccgaggcactggagggtgggatggaggtatcccaagaggatcagttgaagtcattatttgaagagcgactggaagagattgcacaaattgcagagaaagttcctagcctctgtaaagcattgcaaatgccatagttctcatttctatggagcgtgacctgcctgtagtacgaggatttgaccatttgactctgacaaattttagtaggctgcaatgttctttgcagcaaaaggtgcacgccctcattcaagtaaaagggtatattttgtctcatgttggggtgataattctccctgaaagtctccaaaatatatgtgctggttgtagaataaaaattagaacaaacggcctactgtcatatttcatgctccatgctgctagcaagattgtttttcaaggttctttttcggatatataaccagctgaagggtgatagttttcttggtacgtttcacctattggtcgaatttgctaaaatggtcacttctggtcattgcggatcggtataaagccgctatgatagatcatattaatctggggtatatgaagtgtgaattatgaacttagctgtacatttctctgtttatttgggatgaagatagatgtatgcttaggagaattttagacattaaatttggaagtgttttttaaaattaattttgattagcat

SEQ ID NO: 241 - DNA, 1423 bp, Pinus radiata
cgcacttctgtgccggcactcctgtcccacttttgttcggaattatgccgaggcttcatacatgcgggtgttgctcagtcgtttttctttcataaataaaatatatgtagcttgcaagggttcttttttattctaaatttcttgttcaagaagatttacctctagcagtttcttaaaatttccggttgccatagtctagtggggtgagggttcattctaggggatttattgtgtttcacttccgcatcgaagcttcataggctgacgcattctgttcatttgataatatctttttgacctagctgaaagcttctgtgcccaggatcttacgttactgcaaccatgcctgaggaccgaaaaaaaatcctggaagcattggcggccaagagaaaggccgaagccgagagcggggaaaaaaagaaaaggcagaaaagttctttgaatcctgccaaacctgttagcaaacctgttagtaaacctgttggtggaattggtagcaagggaaagtcgacatctgcgccaatttcttcgactaaggctaagtctaagcacaaggaagaggtaaaggcaaagcgtgtaaccaagatggataggtatgagactgatgaagacgatgagtctgaggaggaagaggatttagattctgaatcagatgatgatgaactgtctgatgaggattctgaagatgatataaaatccaagtctgtaaagaaattgcctcctcagtccaagggaaaagctcctgttaaaggaattagtagttcaaatgggaagggcagggatgagaagggaaagggaattatgaaagacaagggaaaggcgaaagcaaaagtggaggaaagtagtagtgatgctgaaggtgacagtgatgatgatggaggtgacttgtctgatgatcctttgcaggaggtcgatccttcaaatattcttccctcaaaaacacgtagacgagcttcacagcctacgaattatcagtttgcaaatatgagtggggatgacgacgacgacgacgacagcgactagatgatgaacctgataaaactgttttggggctctcgatggtaagttttccacagtgatgagcaatataatatatgctctgaattgtgaaatgtggaatgcaagatcctctttctggtattaggtgaactaggtagtaatatttgcttttgcagttagacagaacagaattccctttggccttcagtggtcggtattggtcctatcgatatggtatattttattgcttcactttatttatgctgcgcaaactgttgacactcgggatctttattttcgttttgacacgtcctgtgtttttacaagtagtttgttatttgattacataatgcatgttactctttggaaggaacagagctacaggttcttttctataagatatagttgttgtgtaaaaaaaaaa

SEQ ID NO: 242 - DNA, 2764 bp, Pinus radiata
cttaaactccatttctcactcacgagtttacccaagcctctctgtgcaagcacgaattcgcatttatttctccattacgtgacacagagggttaggtgattaattaactatcggaggattaattgaaattctaattatcagttcgctccctccgtttttctcttccccctttcagtctcgtatggattagccacttcgcttgtaataacaatggcagaatcatcatcataatcatgcgggcggcgaggtgggtttagggtataaggttaaacagagcatccaacgacctacctagactggttcacgcgctaagatttttattgtagtatttttgttgcacatagtgggcattggggtatttatccaaagccatattgaaaaattaagacttgtatcgtatgaaaaaataaatattcatggcagatgtaccagagtctctgcaacaagaaaaggatgaacagggaactgataaaaattgctgtgatggcaaatttcagaaagagatagacattgatgacatggaagaggaatataatgaaagcagcatagatgatgaggaagaaaatttatctgataatgtagctaccaataatatgggtactattcctcaagggcaagcatgcatggctgttacagttgaaggcattgagcatgctaattcagttggttgtggaaggaatggcagggaaggcagtgaagaggtcactgctgctgaagatatggggcatgtatccatagaaaatataagagaacaaggtcgtaataggaaaagttcggagcaattgcttgctttgtatgaacaagaagggctgttggaagatgatgaagatgatgatgatgtggactgggagccttttgaaggtgtcactgtgcagatgaaatggtattgcaccaattgcacaatggccaattctgatgattcagtccactgtgattcatgtggagaacatcgcaattcagacattctcaggcagggtttcttagcatcaccctatctacctgcagaaagcccaagcagttcagatgttccagatgagaggctagaagaaagcaaatgtgttatgaccactctcacaccttccatatctcccatgattggggtgtgttgttcatcattacagtcagagagacgaacagtggttgggtttgatgagcgtatgcttctgcattcagagattcagatggagacatatcctcatccagagaggcctgatcgccttcgtgcaattgctgcaagccttagagctgctggtttatttccaggaaaatgtttctccatacctgcaagagaggctacttgtgaagagctgcaaacgatccattctttggagcacgtgaacgctgttgaatcaacaagctgtggaatgttaagccatttgtcaccagatacgtatgcaaatgagcattcgtctcttgcggccagacttgcagctggtttatgtgctgaccttgcaaaagcaatcatgacaggccaagctcagaatgggtttgctttggtaaggcctcctggtcatcatgcaggagtaaaagattccatgggtttttgtcttcacaacaatgcagcaattgctgtctcagcatcccgggttgtaggagcaaaaaaagttttaattgttgattgggatgtacaccatgggaatggtacacaggagatctttgaggcagatcaatcggtgctttatatatccttacatagacacggagagggtttctatcctggtagtggtgctgttaccgaggttggtagctccaagggagagggatactcggtgaacattccgtggaaatgtggaggagttggggataatgactatatttttgcatttcaacatgccgttcttccaatagcggagcagtttgaacctgatttaacaataatatcggcaggctttgatgctgcaaagggtgatcctcttggtcgctgtgaagtcactcctgatggttttgcacatatggctcagatgttgagttgtctttcaaagggaaagatgcttgttattttagaaggaggttataatctacgttcaatatctgcctcagctacagcagtgataaaggtacttcttggtgataatcctaaagccctacccattgatatccagccttccaaaggtggattgcagacacttctggaagtgtttgaaattcaatcaaagtattggtctagcttaaaggggcatgaccagaagttgcgctctcaatgggaagcacagtatggcagtaaaaaaagaaaggtgataaggaaaaggcacatgcacattgttggaggtccagtctggtggaaatgggggcgtaaaagagtggtgtattatcattggtttgcaagggtatcatctagaaagcatttgtgaagtgatagtttccatttcttccatttattgttgacagcgctaaaagatggaatggacaggtttgaaggatggcctcagcttgcttttatctgcagataggatgttacttcatttttgtacagattaatttgcggcaaattggcatcatatatgactgtctgggaaatcctgcactagtggtgtaacttgtggcgggaaggaactgcacagacatgagttgtgattttgatgtaatcctaattttatctattgtcaccttggttgaattgtcaatattttcatgtcccttgaggccaatctttgaaatggagaatgtttaattgtagaatacatgtgacaatattaattcttgaaggttgcacattcttagttttaaaaaaaaaaaaaaaaaaaaaaaaaaaaaaaaaaaaaaa

SEQ ID NO: 243 - DNA, 940 bp, Pinus radiata
taggagcgagcgagagtattacctcattcaagacaggattcaagagcggagtgtagcatcgacataaaatggcaagtggagcaggggcagcaggggtggtcgaatggcaccagaagcctccaaatccaaagaatcctgtcgtcttctttgacgtaacgataggcaccattccagccggacgtattaagatggagctctttgccgatattgttcccaggacagctgaaaactttcggcagttctgcacaggggaatacaggaaagcaggcattcctattggctataaaggttgccattttcacagggttattaaggacttcatgattcaagctggtgattttgtgaagggagatggcagtggatgcatctctatctatggtagcaagtttgaagatgaaaacttcattgctaaacatacaggtcctggcctcctctctatggcaaatagtgggcctaatactaatggatgccagttctttttaacttgtgcaaaatgtgattggctggacaataagcatgtggtttttgggagggtactaggagaaggactcttggttttgaggaaaattgaaaatgtccaaactgggcaacataatcgacccaagctaccttgtgttattgctgagtgtggtgaaatgtaacaaccaaatgcctgtcaatattgtgtcatgggatgatttatctgctcatggatgttagttcgactagcctcagttttatcttttgtttcgttcccacagggaatttttaatgaaatgaggagaccattgcttagatatttatgggtctatcattagcagataaaattctttatggtcacgaacaacagtaatgcaagagcttgaatatgttccaagctctccagtttgttttaatggcattgcggacttatataaatcagtataccagtcctttgttgcctggtttaccaaattttgtt

SEQ ID NO: 244 - DNA, 1779 bp, Pinus radiata
aatatacgtgtgccattaagccttacggcctctaaaaatcgatttaatgaacgaagatatgttgtaagcgagggccgaagtgttccaaccttatccgtgaagatgatgtgggagacctgctaagagaaagcccgagcagacaaggtgagtggactgctgtaaggaccgacaatggcaaaattggtatcatcagtatgtgcattttcatgtcagcagcggcaccctcactctcgacctcgtttcctatccaaccgggaccattataaccattaccataatcattctcattatcataatgtttgctattttccaccaatgatgatgatgcagcaacagttgcagaagcagaagaggatgacgacgaagaccattacatccttgttcaaatgcaactcttcaaaccacacattgctcaagggactgaaggaattcatgggcttcaaattcagattacaagcggcaatgctttcttgcgaaatgagcatccttggaagagtgtttgctatattttttattgttcatcaagcagctgccccatttccttttaatcattttgacaattggttagtccctcctgcaagtgcagtgctttattcacctaacacaaaggttcctcgaactggagaagttgcactaagaaagtctattcctgccaatccagccatgaaaagtattcaggacttcttggaggacatttactacttgttaagatttcctcaaagaaagccatatggtacaatggagggagatgtaaaaagtgctcttcagattgcaataaatgagaaggattcaatattaggttcagttccattggatatgaaagaaaggggattacaattgtacaacttccttattgatggtcagggagggctgcaagtccttattgaatatataaaagaaaaagatccagacaaggtctctgtgaacctttcctcttcattggatacgattgctcaattggaactcttacaggctccaggtttaccatatcttctacctgaagaatatcagcagtatccaaggttgaatggaagagccacaatagagtttacaatggagaaaggagataattcaatgttttctgtgtcaagtggaggtgggctccagaaaacagctaccatccaggttgttcttgatggatattcggctcctcttacggcagggaactttacaaaacttgtgatagatggagcatataatggacttaagctgaaaactactgagcaagcagtcatttctgacaatgagcgtgctgaagctgggtttaacctacctatagagatattgccggctggtgggtttgaaccattgtataggacaactttgagtgttcaggatggcgagctacctgtgctccccttatctgtatatggagcaattgcaatggcacacaacacaatatcagaggactactcatcaccatcacaatttttcttttatctatatgacaagcgcaatgctggtctaggtggactttcatttgatgaggggcaattttctgtttttggatacacaacagtgggcaaagagatacttccacaactcaaaacaggagacattatcaaatcggccaagttagtggatggctttgatcaccttgtgttgccatcttcaagtacctagaatctttcattcatttcattcaaattcaatgctagagttgtaaacagtgtaataaggagcagaagttgtgatagcttttaggaacgatagactttgtaaattgacaaatccatgtaatatttatccaatagaaaaaggaaatacataaaaaaaaaa

SEQ ID NO: 245 - DNA, 2024 bp, Pinus radiata
gttttagtttttgacgagtgtctttctaggtggggtgttaggggaattgctcaccggattttgattttctggtctttttatgtgcgtggctcgtgtagtttgatactgaacattcaggaattgaagcttcttcacaaggattcggattttgatttgtttcagaaggtggggtacaagattcagtagcgaagttcagtgttttgccgaagggctctttcaaattaagtaagatggatcactactaccaagatgactttgattatttggtggatgacgagatggttgattttgctgatgacgtcgaagatgatgtacgcacccggcgcaggagtgatatagactcagattctgaaaatgatttcgattcaaacaataagtcacctgacacaacagctcttcaagccaagagaggaaaagatattcagggtattccatggaatcgattgaactttactagggaaaagtatagggaaactcgtttacagcagtataagaactacgagaaccttccacggccgcgacgcagtcgcaatctggacaaggaatgtactaattttgaaaggggatccagtttttatgattttcgccacaatacgagatcagtcaaggccactattgtccactttcagttgaggaatttagtgtgggcaacatcaaagcataatgtttacctcatgcagaattactctatcatgcactggtcttcactaaaacagaaaggggaagaagttcttaatgttgctggtccgatcattccatctgtgaaacaccccggttcatcaccacaaggtctgacaagggtccaggtcagtgcaatgtctgtgaaggacaatttagttgttgctggtggttttcagggagaacttatttgcaagtatttggacaaaccgggagtgagcttctgtacaaaaatatctcatgatgagaatggcatcactaatgcagtagagatatacaatgatgcaagtggtgcaacacgactaatgactgcaaataacgacttggcagtacgagtatttgacactgaaaaatttacagtgcttgaacgcttctcttttccttggtctgtaaatgtgagtgttaattcttcgtcgagatcactgtgtcttatcggagggaagtttctgctggttttaatttgacatatcagatgacatgaacttattgcaagaaatattactgtcttgttcatcctgtatatagacgtgtatgttaaatgtcaaatgtacattatccggtttctgagaggacattgataactttgcagcatacgtctgtcagtccagacggtaaacttgttgcagttcttggagataatgcagattgtttgcttgcagactgcaagactggaaagaccgtgggaactctaagaggtcatttggattactcttttgcagctgcctggcatccagatggttatattttggctacggggaatcaggacaccacctgcagactttgggacgttaggaagctttcatcttccctagctgtcttaaagggtcgaatgggtgctataagatcgatacggttttcatcagatggccgctttatggccatggcagagccagccgattttgtgcatctatatgatactaggcagaattatactaagagccaggaaattgatctttttggggagattgctggaatttcattcagccccgacactgaagcattttttgttggggtggctgatcgaacgtatggaagtcttcttgagttcaaccgtcgacgaatgaattactatcttgattccatcctctgagttttgaaagttaatgggagtggtgttttcttgaagtgaaatggcatcattctgttgaaccaattcttgtatattagatatgtaacatgtatgaatgtccatagagcagagctttgctcaatcagaggcttcaaaacccaaattccaaggtctatcgaagcctctttgtttataaatggtgttgtggtggatacagctttctggttcacgctgtagattttttaatgtatgtaacaatttcagcggaaaaaaaaaa

SEQ ID NO: 246 - DNA, 4291 bp, Pinus radiata
atcttcgggtttttcccctgaagaggtctcggtcaaactcgggctttgaaagaagcgttttatgggaactttgtgcctcgtttcgttgacgaatctgtgccccttttctttgacgaatttggtgaagagctctgaagaagaagatgtctttgctctgctgagaggttttcggaaccagggttctgccaaaatcggtccgcgtaactgttttgttgggttgttaccgtgtagagtctgatttggtatcgtctatggattctttcggaattgaaaacaaggaaagttaggggtttctaagcctattttgtccttgatgcctttaggaaaaagtatcgatgatttagctgaatttctgagtaatctcagaaaatagtaatggattgctcgggcgacgaggaggaggagcagttttttgagagtctggaggaaatgttatcaccttcagattcaggatcagaggctgcagataatgagacggggtgcagaaatgccgatgcgaggtctaagtacgagatttggaaaagagcgcccagtagtattcaagaaaggcggcagcggtttcttgtgcggatgggtttggctaatcccagcgagcttgggaatcaggtgaattccacatctgctgaatcaacttgttctacggaaactgcaaacattccaaatggaattgaaaggctcagagagaatagtggggccgtattaagaactgcaggatcgagtggcaggaagacgcactgtaaaaatgttattaatatcggtttgagagagggttcggttcggtctagtagctcaagcaatggtaccccagatgtgggcgaggataatggagaattcgggggcaccattttctcccgttcaggtggcacttgggaatgcatgtgcaaaattaagaacttagacagtggcaaggagtttgttgtagacgagttggggcaagatggtctatggaacaagcttagagaagttggaacagatagacagctaactatggatgagtttgaaaggtcgctggggctctctcctcttgtgcaagaactcatgcgcagggaaagtggggtggcccaagcagattgtaacggagtacatcatcatgatgcagagatttcaagcagcaaaaggagaagctggctgaaagccctaaaatctgctgcctattcaatgaggcggcctaaagaggatcaaagtaactatgattctgagagaagtgggcgaagatctggttcctttgatgttccttgggggaagcctcagtggactaaagtgcgccactataggaaacgttataaggagtttacagctctttacatgggtcaagagattgaagcccacgagggctctatttggacgatgaagttcagtttggatgggcgttatctagccagtgctggtcaggattgtgtcattcatgtacgagaagtgattgaatcaatgagaacgtttggggctgatacaccagatttatatgcttccagtgcttacttttccatgaatggtttgcaagagctagtccccttaagtattgaagaccatgcaaacaaaatgaaaagagggaagatcataggcagcaaaaagagttcaaactcagactgtatagttttacctaataaggtgttccagctttcagaagagccagtgtgttcttttcatggtcaccttcttgatgtatttgatctttcatggtccccatcacagtatttgctttcgtcttcaatggataaaacagttcgactatggaaactgggacatgaaagttgtctaaaggtgttctctcataatgatattgtgacatgtatacagttcaatcctgttgatgagagatacttcataagtggctcattggatggaaaagcccgaatttggagtattccagaccgtcaggttgttgactggagtgatctgcgcgaaatggtcactgcagtatgttacactcccgatggacagggaggactagttggatctatcaagggaagttgccgtttctataatacatcaggtaacaagctacagttggaaaatcaactgaatgtgcgtagtaagaagaaaaaatcttctggaaagaagattactggttttcagtttgcaccaggaggagattctcagaaagtattgataacgtctgcagattcacgagttcgagtttataatggttctgagcttgtttgcaaatataaaggttttcggaacacctgcagtcaaatttctgcctcatttgcaccgaatgggcagcattttgtttgtgctagtgaagattcacgtgtttatatttggaatcatgagagccctcgtggttctggtgcaaggcatgaaaagtcctcttggtcacatgaacactttctatcacagggtgtttcagttgcaattccttggtctggtatgaagcttcagcctccagtttggaattcacctgaatttatgcttggtcagaggcacaatttgctttcattgcagggaggtaaggatgttggatgtcagaatggtcttctttcaagagaagctggtgaggggcaggaatcagagactcctttgcattatatttctcaagtatcacattcatgtggttcacagaatatggtagatagggatggtcaagatgatctttctagatattcagcttgtatctcggattcacgtctgtcatcttttatggctttccctgaatctcctggaaacccagatgatctaaattcgaaagtttttttctctgatagctcgtctaaaggctcagcaacatggcctgaggagaagcttcctccaacaagaaaacagagccgatcaaatagtacttcttctcactatgacactctgaagactcatcttggtaataccatccaaggccaatctggagcttctgcagctgtggcatggggattagtaatagtcactgctggtcacgggggagagatcagatcatttcagaattatggcttgcctgttcgtctttgagaagtcaagtatttatagttaagtgagagagcaaggaaactttacccttttaaattgtcatttcagcataaatacacatttgtattgaatgctttcctcatctcaaattgtatttaatctgcgggcagtatgggaagattgccattctttcagaaaatgaaggtgcatcttgatgcttccaagcagtccttgcatttttttagagtattgtgggcttccaacaatgtggagttggataagtttgacactcgatcacaattgtccaatctgttcgttatcattttcctttgctactcaaaaaagtgtatggcatctgattgggccctcttatgccctgctgatctgctctccattgaagtagaaaaagtgggggacggatcaatcaatagctctactgtgcaacgaaccctctgctccattcatccaaccagctgagaatgtgtggttatcagtaccactgactatacacttaagttattcagttgatgcagaggtgctcctaagattgtgtcgcccctattgcagcatgttcagcaagggaccgttagcccttgccttccccaagtatataatgtgtatggcaagatgactcgtccaacagccttgaagatgtagtcaagagtgcaagcgatttccacttgtttagttccctgaagctggatttcttcagccaggcacgcttaactaaatttcgtttagttcaccatgactattcgttgaacttaatgagatttagtttaacgtagccagcccgcttctgcattatcttagaaacggatgtatattggaacagaccaggtgctttaggtgattaagtgctggacaaaacgaggatcccttgaaattcttgagagaactttttgttgttgttgagatgaacaacatttgtgagttatcacaaatgaccatgctcttcgtgcctgagacttttccctgtagtatagacttgagttgtccacgtggtagtgatggttttgctttaacccaatgctatgtccatgtaaacagatattttggacattttttgatcttactagtactgcttaagaatttgtaaatgtaactgctgccatgaagatcgttagggctttgacagcagcattgttggttagccaatttaggatgttatgattaaatgctagtgttttccaagtggttgtagcatatccactgttataacatattcgggagttaaaagatgaaatataaagggtcctacagacaacctaagtttcaattctttttttggattcgacataggacggtggatacaattgttatcctgcaagcaatgaaataaatgcgcacgagtgcctttttgtcatgcaaaaaaaaaaaaaaaaaaaaa

SEQ ID NO: 247 - DNA, 1779 bp, Pinus radiata
acgaatcaatagtattaaagggctttcaaatacttgctttgcaaagcccgggaggcattggggacattgtagattgacctaatagccgattcaaatttatcacacgatgccaagcataccagcaattggagagtttacagtctgcgagatcaatcgtgagctgcttacgactaaagatgaatccgatacacaagccaaggatgcctatgcaaaaattctggggcttgtgttccctcctatttctttccagatagaagaggggtttggcagtgcatctagacagcagtttgatcaagatctggatagagaagacacaattgtcaccccaagcaccagtgagggcacaaatgccctgcaagaagggggtcttcttttgaagggtgtctctgttctaaaaaatatcctggccagttcatttggaccgattttttctcctaatgatacaaaagtactaaagaaggttgagcttcttcaaggaatcagttggcataggcataagcatattctagcatttatatcgggatcaaatcaagttactgtacatgattttcaagatccagagtggcgtgagtcgtctttattagttagtgaatctcaaaggggcattgaggctcttgaatggcgcccaaatggtggcacaacactgtctgttgcttgcaggggtgggatctgcatttggtctgcatcatacccaggaagtgtagcacctgtgaggtcaggggttgcttctttcctgggcacttctactcggggaagtagtgtgcgatggacattagttgactttctccaaattcctggtggcaaagcagtgacggcactatcttggagtcctacggggagattgttggcctcagcatcacgtgaagattcatcatttacaatctgggatgttgctcaaggagtcggaactcctctccgccgaggactaggaggaatatcattgctgaagtggtctccgacaggggattatttgttctctgcaaaaccaaatgggacgttctatctatgggaaacaaatacatggactttagagcaatggtcatcttctggaggctgtgttattagtgcaacttggggacctgatggacgtatgctttttatggccttctcggagtccacaacattgggctcacttcactttgccggaagacctccatcactcgatgcacatttactaccgatggagttgccagaaattggatccataacaggagggtttggcaacattgaaaagatggcttgggatggatgtggagagagattggctgtgtcatacactggtggagatttgatgtacgttggtcttattgcaatctatgatacaaggaggacaccatttatatcagcatcattagtaggatttattcgaggaccaggagaacaagtcaagcctcttgcatttgcattccatgataagttcaagcaaggacccctattatctgtgtgttggagtagtggtctgtgctgtacataccctttaatatttcgagcacactgattgctggtcaaaaccccttgtagggtggacttctgttgtatccaatttttatggcataattagctagttttggtatttgcatagattccagaattccatttagttttttagctcgagaagaaagagttcttttcaagaattgtgttgtttttaaaaatcgataagccttaatatgatattttgaaggaaatcacaatgccattgtaaaatgtttggcttcctattcatatcgtgtctatgttggttgccctttcttaaaaaaaaaaaaaaaaaaaaaaaaa

SEQ ID NO: 248 - DNA, 1534 bp, Pinus radiata
cagcgaagctgctaattctacctgttttagagcgggggttttgaaagggttttagattccatctgttttgaagggttttagatttgtcaggtttccggaaacgtggatacctgcataatggaggaagaaaacgcaaaacacacggaggagacaaggcaggtgcaagttcgattcacaacgaagttgcagcctgccctgagagttcccaccacgtctattgcgattcctgctcacctcaccagatatggtctctccgatatcgtcaatactctcctcggcaatgacaaacctcaacctttcgactttcttgttgaaagtgaactggttcgaacatctcttgaaaagctgctcctcatcaagggcatatctgcggaaaaaatacttaacattgaatatatattggcagtggtcccacccaaacaagaagagccatcgttgcatgatgattgggttagtgtagttgatggttcttatcccaacttcatatttagtgggtcgtttgatagcattggaaggatatggaagggagaaggcttatgcacacatgttttggagggacacagggatgctatcacttctgctgctttcatcatgccatcagattctagtgatagttttataaatctagctactgcctcgaaggatcgaactctacgactgtggcagttcaagcccaatgagcacatgacaaatgggaagatggttagaccatacaaacttttgaaaggccatacctcatctgttcaaactgtatcggcatgtccacgtaggaatttgatttgttcaggttcttgggattgctctataaaaatatggcaaactgcgggagagatggatattgagagcaatgctggttcagtgaagaagagaaaattagaagacagcacagaacagattatttctcagattgaagcatcaaggacgttggaaggacatagccaatgtgtttcttccgttgtctggcttgaaaaagatacgatttattctgcctcttgggaccattcagtgcggagttgggatgttgaaactggcgttaattcattgacagtgggttgtcggaaagcactgcattgtctgagtatcggtggtgaaggctctgcactaattgctgcaggcggggctgattctgtgcttcgaatatgggatccgcgtatgccagggacttttactcccattcttcaactgtcatcgcacaaatcctggatcacagcttgcaagtggcatccaaaatctaggcatcatttgatctcagcttctcatgatgggacattgaagttgtgggatgtcagaagcaaggtcccgcttaccacattggaggcacataaagataaggtgttgtgtgcagactggtggaaagaagattgtgtgatatctggcggggctgattcaacgttacagatattttcaaacttaaacctcacatgaatcggtggacattctccggtgcatgtatgggcatatttttgatagagttcgcgatgttttaaatttatccagagtcagtattagagcaagtcccaataaaagtctttgg

SEQ ID NO: 249 - DNA, 1034 bp, Pinus radiata
ggcacgactttacccttgatgtgtgttagggggcactgtttaaaaccctcgagggagggctgagggctgctacagcatccgcatttgcatctctgctacgactaaggaatcatcctcttctacaatgccatgccgtgatcggtcgattgcattaagtgctgcaaggatcaaatagtggcactgtcatgaacaggttgaggtcaaagcgcaatcatattttggaattaaggctaggacaatcagaaccagaaaaagaagcaacattggcgtctaatcggagcaggggcacgaatgccccaatagtagttgaggatgatgatgatgtagtggtgtcatctccaaggtcatttgctctagcaaggagttcagtgtctcaacgaagtagtcgcataccaatagtaaatgaagaagacttggagcttcgacttggactggcagttacaggaaggacatcagcagagcacaatccccgtcgcaggcatggtagagttcctccaaataagccaattgttctttgtgatgatgctggagaagctgatcaaagttcttccaagaagaggaggactggacagcaattaagcagtgatgttcaatctgatgaatcaaaggaagttaagctcacatgtgcaatttgtatatccacgatggaggaggagacatcaactatatgtgggcacatcttctgtaaaaaatgcattacaaatgctatacatcgatggaagagatgcccaacttgcaggaaaaaacttgcaatcaacaacatccaccgtatctatatttctagcagcactggttagctattcatcgttgtacttgttgccaaattctgctagttcgtaggagaagctatgtgtttgtacttccttatgtgtgacataagagaatgtcaaaagagacatttctcgcacttgttctttatctgcacgttaaaatgtttttagaaacatctgccaaagcactgatgatgatatttacaacttgaatgatgacgaaggctattggaacagccattgggatctatttaaaaaaaaaaa

SEQ ID NO: 250 - DNA, 2976 bp, Pinus radiata
aaatgcggagtgacaattgaactcttcccattccttcagtgcgcggaatatcttggggaaaaaaaaccgctgtgttcatttttgttgatcaacaattgctttttatcatcgccacgaagtacagggtaggtttaattcgcttttgttcaaggaagcctgcgtgattttgtcgatggtaatctattctccttgggaggtgccccaaattaatgttaatatcaacgggagtggaattttcgttcccagcaggcgcgaagaggaaataactaagttgctctgcaagcactgcatgaaatcgcattaattaaaccttattttgggttcttgagtagtgctatctataaaataatacaaaactcgcaacaatagaaggctcccaggtcactatggaagagccacccccacctgcggtgttaccgtcatctgaggatacctccattgttagctcgcatagctttgtcaatgcacccccaactgtccctgttggtttagatgcttccattccccaaatttctacgccgggaattaaccaacctggcttaaccatccctgtaccacccgaagcagctcctctaactgcgtcattagttgctgcttctgctggcatgccccctgcagttgtaccttcctttgtccgcccagctatcgtagcccatccatcggttatgcccccgcccagcatgcctcttgcagccttgcccatgccagttgcttctgctgtacctgttgctgcaccacatttccccccttcaaccccaaacgataattctattactccatctatgcccgttcctactcccattgtagcctcatctagtgtgccgccttcggtcacaattcctggaattgctcccctgccatttattgctcctattcctgtgccttcgtcgcgccctgtagctccatcgccctttatgcctcctgctcgtcccttaggagctagtgtttccgttgcaatggatgtagacaatactgatgaacaagatcaagatgcagacaacaagggagaaagtccttcgtcaagtcccgaccatccagaagatccttcagcagctgagtatgaaattacagaggagagcagaaaggttcgagagaggcaagagcaggctattcaggagcttctgctgcggaggcgtgcctatgcattggcagtccctaccaatgactcttcggtgcgtgctcgtcttcgtcgcttgaacgaacctattaccctgttcggtgagagggagatggagagacgtgaccggctcagagcgctcatggcgaagcttgatgcggagggacagcttgagaagctcatgaaggttcaggaagaagaagaagcagctgccaatgttgatgctgaagaggtccaggaaatggaagggcctcaggtatatcctttttatactgaaggctcccaggagctgctaaaagctcggactgagatcacgaaattctcactccctcgggcagtctcgaggttacagagagccaggagaaagagagaggatcctgatgaggacgaggatgaagagttgaaatgtgtgttgcagcagtcagcccagatcaatatggattgtagtgaaattggagatgatagacctctttctggatgtgcgttttcttcagatggaactctgctagcaacgagtgcttggagtggtgtcacaaaattatggagtgtaccaaacataaataaggttgctactttaaagggacatacggaacgagttactgatgtggcattttctcctacaaactgccatttagcgactgcctgtgctgatcgtactgcaatgctatggaattctgagggagttctgatgaaaacatatgaaggccatttggatcgtcttgctcgtctcgcatttcacccatctgggctatatctgggcactgctagctttgacaagacgtggagattgtgggatgttaacactggtattgaattgctcttgcaagaaggccacagccgaagtgtgtatgggattgcttttcagtgtgatggttcattagcagcaacctgtggattagatgggttggcacgcatttgggatcttcgtacgggaagaagcattcttgctctagaaggccatgtgaaaccagtccttggcatagatttctcgccaaatggttaccacttagcaactggtagtgaggatcatacctgtcgcatttgggacctaaggaagaggcaatcagtatatatcatacctgctcattctcaccttgtttcacaggtcaaatttgaaccacaggagggatatttcttggtcactgcttcatatgacagtactgctaaggtgtggtcagcacgggacttcaaatccatcaaggtattggcaggacatgaagcaaaggttacgagtgtggatattacagcagatgggcaatatattgctactgtgtcacatgatcgtaccataaaactttggtccagcaaaaacagcactaatgatatgaatattggttgacaccattacagatgggcgatatgtttccagtgtcacatgatcgtactagaaaattttagtccagcaaaaccattagcaacactaatgatatgaatattggttgacatcatgatgggtagtgttgttatgtcgtctctgtaggcgatgtgaatgcaatttgttgctgccttcgcagtattcaaaacaaaacattgaagcaaatgctgctgatccaacgtttacagtacttaatcttcctataatgcaatctgcgttgagaacattcttttttctgagatatccatgacatgtatatgataagtgggcagttaggcttcactttcagtcttgcttcagctactcggttggcaaaaattttgtgaagggaaagggcaacacatcactggacataattttaaaatatgatgcagaacttttgttcacgaatgcctcgtgtactttatacaaattacatttggaatgctaagatgtaaatctactgctacttgaaaaaatgcttcttgaactgatatgctccagg

SEQ ID NO: 251 - DNA, 4412 bp, Pinus radiata
cttttactcttgcatttatgccatctgaaaacccgaggtgtagttaatgcacctcggcagaagccaagatctccttcgggctttgccgagaagtacgagtggattgaaaggaatttggagaaataggagcaggaagtgaacggattttaaaacttacaggatcctgtgacatgggcaggtttttttgaatggtaatgggcggtttttgatgtcagatttggtgctgtgaaaacataagagccggcattgtgcatttcatagtttttggtggtggggattggactgagaagagttatgcgaaaccagcgatatagaagtccaacactgatttcagagcttttctccggtcaccaaaaccatgaagcgggcttacaaattgcaggagtttgttgcgcatgcttccaatgtcaactgtctcaagattgggaagaagtcttccagagttctggtgacgggcggggaagaccacaaagtgaatatgtgggctattggaaaaccgaatgccattctgagtttatctggtcattcaagtgctgtggagtctgtgacttttgattctgcagaagctttagttgtcgctggagctgctagtggtacaataaagctatgggatttggaagaagcaaaaattgttcggacactcactggtcataggtccaattgtatatcagtggatttccatccatttggggaatttttcgcatctggctccttggatacaaacctaaaaatctgggatattagacgtaagggttgcattcacacttacaaggggcacactcgtggtgttaattcaatcagatttagtccagatggtcgttgggtggtgtcaggtggggaggacaatattgtaaagttatgggatctaactgctggaaagctcatgcacgacttcaaatgccatgagggtcagatacagtgcatggatttccatcctcaagagtttcttcttgctacaggctcagcagacaggactgtgaaattctgggaccttgagacttttgagcttattggatcagctggtcctgagacaactggagttcgtgccatgattttcaatccggatggaaggactctgttaactggattgcatgaaagtttgaaggtgttttcctgggaacctttgagatgctatgatgcagtcgatgttggttggtctaaattggctgacctcaacatacacgaaggaaagcttcttggttgttcatacaatcaaagttgtgttggtgtatgggttgtggacatttcgcgggtggggccatatgctgctggaaatgtatcaagaacaaatggccataatgaagcaaaattggcttccagtggtcatccatctgtccagcaattagataataacttaaagaccaatatggcgaggctttccttgtcacacagtacagagtcaggaatcaaggaaccaaagactaccacatcgttaactaccactgaaggtctttctagcacacctcaacgagctggaatagccttttcttcaaagaatcttcctgcaagttcaggtccaccgtcatatgtctcgactccaaagaaaaatagtacatcaagggtgcagcctacaacaaattttcaaaccttaagtagacctgatatagtgcctgtcattgtccctagaagcaattcattaagaccggaaacaacatcagatgctaagaaagaaatgaacaattttggaagagtggttccatctacagtatcaaccaaatcaactgatgtgattaaatctggcagcaacagagatgaatctgacaagatagactccataaatcagaagcgcatgacaggcaatgacaaaacagacctaaacattgctagggctgagcaacacgtttcctctagacttgacaatacaaacactagttctgttgtttgtgatggaaatcaaccagcggcaagatggattggtgcagccaaattcagaagaaattcaccagtagatccagttgtaagcccacatgatagaagtcctacttttccatggtctgcaactgatgatggagttacatgtcagccagatcgacaagttactgcacctgaattatcaaaaagagtggtagagcctggtcgtgctcgtgctctggttgcaagttgggaaacacgagagaaggctctcaccgcagacacacctgtgctggtcagtggtcgcccccccacaagtcctggagtggacatgaactcattcatcccgagaggaagccatgggacttcggaaagtgacttgacagttagtgatgacaacagtgctatagaagagctcatgcaacagcacaatgcatttacaagcattcttcaagctcgcttgactaagttgcaggtaataaggagattttggcaaaggaatgacttgaaaggtgctattgatgctacgggaaagatgggagatcattcggtatctgctgacgttattagcgtactgattgagagaagtgaaatcttcacgctggatatttgcacagtcatacttccattgcttactcggttgcttcagagcgagactgacaggcaccttactgtcgctatggaaaccctgcttgtgctagtgaagacttttggtgatgttatccgggcaactatatcagcaaccccaacaattggagttgatctccaagcagagcaaaggcttgaacgctgtaatctgtgttatgttgaactggaaaacatcaaacagattcttgttcctttaatcaggagaggtggagctgttgccaagtctgcacaagagttgagtttagctcttcaagaagtgtgacccactctatttaggttgacatttttttttgtaataaatcttctttgacgggaggctgtttgtatattgggaaacactgcattgtttgcaatgatagtggcagtgtggttgaatatgcacggcatcaattgcagtggaattcttatctcaggtcattggagtgtttaaccattcctatgttgtcagccacatcttgtcagccacaccttgattcttagattaagaagttactaatttgtagataaattctaacgaaggtgatgatagcatacacgtaatgaaatcacagagaatgtctacgcagttgacactgcaactagtcttgcgtgaacctgtagttgcggcatgcttcaacctttgttgtaatatttaaaatatttgagtggcttaagcactcaatttcctgtttgatcaagtcagttgctagattcttcagttgcttttctccgttcatacaatcagcaattggatattgatgaatttcattacagagtttgataatctgtgagccatcatatattaattgtacattcataagcatcaagatacgtaatttaaatgatttccttgtgtctgaaaaaaaaaaaaaaaaaaactcgagactagttctctcgtggtgcgatcctctactccaagggcggaaaggccgttgcaagtaagttccattgggagagtctgggtgattgaaacccgccaggaagacgtactgcagtataatctctgctccgaacaggaccttgatctgcgatatcaacctcaaaactcatacagcactgaagaaaaaaactgttgactaggaatggagttgaactcaggtcctgaagttgtttttgattgttctatgtctacaaaaaaatcatgctctggggcatctgcaagagaatggcgaaatttcatgtcatccaacccatctgatatgttcaaacgcacacaatccaggagattaactgagcaggcgtcttctcatgaagagaaggagatattcgacacaatatttaaagaagttgaagagttaggagtttcacaactgccctggaaaaaacggaaggccatggagaaccaaaaggtgttaactttaggtggaaagccttcaaagaatatcaaaacatccatttccgtaggtaaacatattaggaagaagcaaaaacgtacgaaggaggcggcaattaagaatgaggagattcttctcggtcgacctgcaaaacgtgcaaagaaaactgaaaatatacgcaagagagaggatcgagggctgatggcatccgaaggatatttcaaatacgggattttgcatgttaagcctttggagaaaaatgttgaagaacgtgaggaaaatgtatacagaatgggaaaaacaaagaagaaaggcaaatcaaagaaacacaagggaaaaaagaagcgttgatagttctgcatttctgagatgaagcatctttctttttattgttgggcttagctttggcactattggaatattttagcatccagtttgccttcagctattacaaaaatatttgaaaggttttgttttaaattttttttttttcacaatttatggatgaggtactccttatgaatatcttcaaactaagaaataactatatatgcaaataaataaaaacgatttgtaatttttcaatttccaaaaaaaaaa

SEQ ID NO: 252 - DNA, 1757 bp, Eucalyptus sp.
gtgtgcagtttcactactcccccacacactctctctctctctccttttcccccaaatcagaagaagagacgacgactgtgtagtagtgagagaagcggccgcagaccgggcggtactgaaattttgatggagggtttcgggggaatctctctctgctgctgatctccgggagggctggttcgtcttcggcttcgggagggggaggagcgggagatcgtgatttcgaaggaggcagagatggccggatcggacgagaacaacccgggcgttgtcggaggtgcgcacgttcaagagggcttgcgggtcggagcggggaagatgggggcggggaatgttcagcagagacgagctctgagcaacatcaacagcaacatcatcggggctcctccttatccatgcgcggtcaacaaaagggtcttgtccgaaaaaaatgtcaactctgaaaacgatctcctcaacgctgctcatcggccaattactaggcagtttgctgctcagatggcttacaagcagcaacttagacctgaggagaacaagaggacgacccaatcagtctcaaatcccagcaaatctgaagattgtgccatcttagatgtggatgacgacaagatggctgatgactttccggtgccaatgtttgtgcaacacaccgaagcaatgttagaagaaattgatcggatggaggaggttgagatggaagatgtagctgaagaacctgtcacggacattgacagcggtgataaagagaaccagttggctgttgttgagtacattgatgacctatacatgttctatcagaaagccgaggcttctagttgcgttcccccaaactacatggatcggcagcaggatattaatgagcggatgagaggtatactaattgactggctgattgaggttcattacaagtttgaattgatggatgagaccttgtatcttacggtcaatctcatcgatagattcttagctgttcaacctgtagtgaagaaaaaactccagctagtaggggtaacagccatgcttctggcatgcaaatatgaagaggtctcagttccagtagtggaggatctcattctgatttcagacagggcttatagcaggaaagaagttctagaaatggagcggttgatggtgaatactttgcactttaacatgtcagtgcctactccttatgttttcatgaggagatttcttaaagccgctcaatctgacaagaagctcgagctcttgtcattcttcatcatcgagctttccctggttgaatatgacatgctgaagttcccaccctctttattagctgcttctgcaatctacactgctctgagtacaattaccagaactaaacagtggagtacaacatgtgaatggcacaccagctactcagaagaacagcttctgtaagttacttagtttttccttcttccacaccttgagatggcttggtttttgttgagctttctatttcaagcaatttgtgattggggggttctgcattctttgtagggaatgcgccagattgatggtgactttccatcagagggctggatcagggaagctcactggtgtgcaccggaagtatagcacatccaagtttggtcatgctgcgagaactgagcctgctaactttctcttggacttccgtttgtagtgggttgcgtgtgtcgttgtgtaccttgcctaaatcaaacataaaaaactgacttttgggccagggtggggggcttaaaaatatagcaacataagttgccctgcgagtg

SEQ ID NO: 253 - DNA, 1134 bp, Eucalyptus sp.
ccctaaaactcatttcttccttcccttccaagctctctctcctctgttttctctgcgcatgcaagctccacgagagggaaaatcggcggcggccatcgtcggaatgggcaagtacatgaagaaatccaaggcaatcccccgcgacgtctcgctcctcgaggcctccccgcgctccccctccgccaccggcgtccggaccagagccaaaaccctagcctcgcggcgcctccggagggcctcccagcggcggccgccgccccccgctgccgccgccgccgccgccgcgccgagcttggacgcctctccctgtccgttctcttacctccagctccggagccggaggctccggagaccccgtctcgcgccctccccggaggcgaggatcgacgaaggacccgcggggagcggttctaggggaagccgcgacgcttcgtgctcggcgaggacggcatcgtcgagcggtggagtggagggagaaggagcgtgcgtcggtcggggtgacaggggaaacgggggggagtgtgtccgcgatgcggctgtcgacgcgtcttatggagagaacgatttggagatcgaagacagagacaggagcacaagggaaagcacgccgtgtagcttgataagggactcgaacgcaaacacgccaccagggtcaaccacaagacagcagagctcatgcactgctcacagaactcaaatgagcatacttagaagtatcccgacctcagatgagatggaggagttctttgcatatgccgagcaacgacaacaaagatcattcattgaaaagtacaactttgatattgtcaaggatcgtcccctcccaggtcgttttgaatgggtgcaagtaattccatgagatttgcattgatgctggacgaggaggtgtatcgcatacggagtcaatgtactggagtagtaaagagcctgaactgtgacataacagacgacgagcacactgatgagatattaaattaaagtcccttgacaatgtctaaagagccgtgatctatgagtagattagaaaccgcctttttagttgcaaacgccattggagtttgttgagaaaggagaatataccccttgtacataacttgtttcttcagtatatgctcttttctcctaaaaaaaaaa

SEQ ID NO: 254 - DNA, 2097 bp, Eucalyptus sp.
gccaactcgacagagagagagagagagagacaacacggttgaaatggacggtcactcctcgcacctcgccgcgcagaaccgttcgcgcggctcccagaccccctccccctcccactccgccgcctccgcctccgccacctcctccatccacctcaagcgcaagctctccgccgccaacgccagcgccgcctccgccgccgccgccgccgccgccgcggccgcagccgccgacgaccacgccccacccttccctccctcctccatctcggccgacacccgcgacggcgccctcacctccaacgacgacctcgagagcatctctgcccgcggcggaggggccggcgacgactccgacgacgattccgacgatgaggaggaggacgatggcgataacgacggcggatcctctctccgcacgttcaccgcggctcggctcgagaacgtgggcccggccgcggctcggaacaggaagatcaaggccgagagcaatgcgacggtcaaggtcgagaaggaggactccgccaaggacggcggtaatggtgccggcgtgggagctctggggccagctgcgacctccggcgccggttcgggctccggaactgtgccgaaggaggatgctgtgaagatattcaccgagaatttacaggcgagtggggcttacagtgccagagaagagaacttaaaaagagaggaggaagcaggaagactcaagtttgaatgcctttcaaatgatggtgttgatgaccatatggtttggttaataggattaaagaatatctttgccaggcaacttcctaatatgccgaaggaatacatcgtgcgtcttgttatggacagaaaccacaagtcagtaatggttatcagacggaatttagttgttggtggtatcacttatcgcccatatgccagtcaaaagtttggtgagatagctttctgtgcaattaaggctgatgaacaagtaaaaggttatggcacaaggctgatgaatcacttaaaacagcacgctcgtgacgttgatgggctaactcattttctgacctatgctgacaacaatgctgttggttacttcatcaagcagggtttcacgaaagagatatacctggataaagatcgatggcatgggtatattaaagattatgatgggggaattcttatggaatgcaaaattgatcccaaacttccttatacagatctatcaaccatggttcgccgtcaaaggcaggcgattgatgaaaagataagggaactctctaattgtcatattgtctaccaggggattgatttccagaagagagatgcaggggttccccaaaataccatcaaaatggaggatatccctggcttgagggaggctgggtggacacctgatcaatggggctattctaggtttagaggattgagtgatcaaaagcggttgactttctttattcgccaacttctgaaggtattgaatgaccatagtgatgcttggccattcaaggaaccagttgatgctcgtgaggtccctgattactatgacataattaaagaccctatggatttgaagacaatgaccaagagggtcgaatcagagcaatattatgttacgctcgagatgttcattgcagatgtcaagaggatgtttgctaatgcacgcacctacaattcccccgacactatatacttcaaaattgcaacaaggtatacttagtcagtccttgttatgtatgtcttttgtcaacccttcagggcagataaaaatgatttactggatgtgcaggctggaagctcatttccagagcaaggtacaatcgaatctccagtctggtgccggaaaaattcaacagtagagcattcggtagactggaggccctgaccttacttctctctatatgaatatgtggagccttggatacttactctgatccatgattgcgctggggaattaactagcttcgattgaccatgtaactgaagactgatagtcatattccccgaaaactgaaatttcagttcccttagtacaatgtaattaagatgtcttcactttctaactctggtagatggaaatttaaccagattgtgatattgatatatccgttcacctcaaaaaaaaaa

SEQ ID NO: 255 - DNA, 2264 bp, Eucalyptus sp.
ccgtacctccgtcttcctttctatctccattcgaagccgatcgaataaaaaccctagccatccgaactcgactcgccggtgagctttcttgattcggtcgggtccgggatgttcaacggaatgatggatcccgagctcttcaagctcgcgcaggagcagatgaaccgcatgtcccccgccgagctggccaagatccagcaacagatgatgtctaatcctgaattgatgagaatggcctctgagagcatgaagaatatgaggcctgaagatttacgacaagcggcagaacaattaaagcatgttcgtcctgaggagatggctgagattggtgagaagatggctaatgctagccctgaggagattgcagctgtacgcgctcgtgcggatgcccagatgacttatgagatcaatgcagctaaaattctcaagaaagaggggaatgaacttcatagccaggggaggtttaaggatgcctcgcagaagtatttgcgtgccaagaataacttaaaaggaattccgtcgtctgaaggcaagaatcttttattggcatgctcccttaacttgatgtcctgctacttgaaaacaaggcagtacgaggaatgcataaaggaaggctctgaggctttagcatgtgaggagaaaaatctcaaagctttctacaggaggggccaagcatatagagaattaggtcaattgaaggatgcggtctctgacttgagaaaggcacatgaaatttctcctgatgatgaaacaattgcgcaggttctaagggatactgaggaaagtttgaccaaagaaggtggttctgcaccaagaggggtggtcattgaggaaataactgaagaagatgagactttggcctctgtgaaccatgaaagcccatcagaatattcagagaagcggcatcaggaatcagaggatgcccacaagggtccaattaatggtgatattatgggtcaaatgaccaattctgaaagcttgaaagctttgaaaggtgacccagatgcaatcaggtcattccagaattttatttctaatgctgatcccacaactttggctgcaatgggtgcgggaaatgctggagaggtatcccctgacttgattaagaccgcttctagtatgatcggcaagatgtcagcagaagaactccagaagatgattcagctggcttcatcgtttcccggggaaaacccttatgtcacaagaaactcagatagtaattccaatagctttggaaatggatcaattcctaatgtgtcgcctgacatgttaaaaactgcgagcgatatgatgagtaagatgtcacctgatgatcttcagaggatgtttgaaatggcatcttcttcgagagggaaggacccttctctggatgctaaccatgcaagttcaagctctggggcgaatttggccgccaatttgaatcatattttgggtgaaagtgaaccgagttcgtcttatcacataccttcaagttcaaggaatatttcatcttctcctctatcaaatttcccatcatcaccaggtgatatgcaagagcagataagaaatcaaatgaaagacccagctatgaggcagatgtttacatctatgatgaagaatatgagtccagagatgatggcaaacatgggcaaacagtttggactcgagctttctccagaagacgctgcaaaagcccaggaagcaatgtcttctttatcaccagagatgttggacaagatgatgcgctgggcagacagggctcaaagaggagtcgagacagctaagaagaccaagaactggttgcttgggcggcccggtatgattttggccatatgcatgctcctcttggcagtgatccttcaccggcttggctttatcgggagctagagcggcggaatccctttgctcgttcaagctttatgcgacaagtcggccagaaagcagtagcatcggattggaacacgcaatgcatcttcgtcaatccatcttcagatgaaattggctcccctaggcaggggacgttctttagtcgtcggaaggtctgtcggatagaatgggtagaacatagcatatacccatgaagtgctggtggtttgtgatttatgctgacggtttggacttccttccatttaacataaattgtactgcttgtagagataaaaatgtccgagctggaatctcgcaagagattctgatcaagaaatttcattttttctttttagtctggtcctattctatatttattttacaaaaagaaatccattacttgttctttaaaaaaaaaa

SEQ ID NO: 256 - DNA, 2160 bp, Eucalyptus sp.
aaagagaagcaaaaacctggcctcatcggcgcttctcctccttctctgaactccacatcaggctcgtcagtggcagaattcccgtcttcttcttgttgaccgccgtttggttactgtactctcatctaccggtggtgccgaagtattggaggggaggggatttaggaaggtgatctggttattgaattggggtcgtttgtctgttgaagggatgatagcggcgatatcctgggtccctagaggggcttcgaaggcggtccccgaggtggccgaaccgccttccaaggaggaaattgaagagattttgaagagtggagttgtggaaagaagtggagatagtgatggtgaggaggatgatgaaaacatggatgcagttgcttcagaaaaggctgatgaagtttccactgcattatctgccgctgatgcactcgggagaatttccaaggtgacaaaagctggatctggttttgaggatatagctgatggtttgagggagcttgatatggataattacgatgaagaagatgaagatgtcaagctatttagcactggacttggtgacttgtactacccaagtaatgacatggatccctacctcaaggataaggatgatgatgatgacactgaagagattgaggacctgtctattaaaccaatggactctctcattgtttgtgcacgtacagatgatgaagtcaatcttcttgaggcgtgtacattcattagataatgcattttttttgctgcactttcccaggctgtactggggttcacataaaaaccgctactgattggtcaattcattgcataaagcaggtctatttattggagccatcattatctgatgaatcaaatatgtatgttcaccatgaagtagttatttcagaatttcccctctgcacagcatggcttgactgtccaattaaaggtggcgacaaaggaaattttattgccgttggctcaatggagcctgccattgagatttgggatcttgatattattgatgctgtagaaccatgtcttgtattaggcggtcaagaagagttgaagaagaaaaagaagaaaggaaagaaggcatcgattaagtacaaggagggtagtcacacggattcagtgcttggccttgcttggaacaaggagttcaggaatatacttgccagtgcaagtgctgacaggcaagtcaaaatttgggatgttgcagctggaaaatgcaatattaccatggaacaccacaccgacaaggttcaagcagttgcatggaatcatcatgctccacaagttcttcttagtggatcttttgatcattcggtagtcatgaaggatggaagaataccttcacattctggatatagatggtctgtgacggcagatgtcgaaagcttggcgtgggatccacattctgaacacttctttgtggtgtcccttgaagatggcaccgttagaggatttgatgtacgagccgctatatctaattctgcctcccagtcactgccaagttttactcttcatgcgcatgaaaaagctgtcagcacaatctcatacaatcctgcagcaccgaatcttctcgcaacagggtcgacagataagatggttaaactctgggatctgtccaataaccagccttcatgtattgcttcaagaaatccaaaagctggtgctgtcttttctgtttccttctcggaggatagtcccttattacttgctattggaggttcaaaggggagacttgaagtatgggatacatcatctgatgcagctgtatcccgacgatttggaaaacatggcaagccgaaaacagcagaacctggttcttgatgctgccaagtgagaacatgttaaaaatatcttagatcttctcaatgtcggccttgcttagttcttagagcgcattgaaatgcctgaagtcaggggtagttctgcaagtcgagtcatgttcttttagcagcttgttatttagcattttaagtgtcttcgtattatttttgggtgttgagaaggaaaaaagaaagtgttttttctttttcttggggaggtgggggctttggcgtgaggttactgcaagtatgcaagagcatcacaaggaaaaggtcccagggaaaagtgttgaacatggtaaatgaagctaatgcaatggtgtctttttgactccgaaaaaaaaaa

SEQ ID NO: 257 - DNA, 1538 bp, Eucalyptus sp.
aagtgcaggtcagcgtcgacaccaacaaaagctggccccttccctccttcgtatatatctcgtctcgtctcgtctcgtctcttccgcagaaaccctccccgcagcagaactccgcctcgtcatacgaaaatctcgcgtcgtttgcagaaaacaaggatcgatttgactacccaaaacgcagatagatagagagagagagagagaggatgaagttctgcaagaaataccaggagtacatgcaagggcaagaagggaagaagcttcccggtcttgggttcaagaagctcaagaagatcttgaagagatgcaggcgaagagactcgcttcattcccagaaggcccttcaagccgtccaaaatccccgcacttgccctgctcactgttcggtgtgtgacggaagtttcttcccctctcttctcgaggagatgtctgctgttttaggctgttttaacaagcaggcgcagaagttgcttgagcttcacctggcttcgggatttcagaagtatttgatgtggttcaaaggcaagcttcgaggaaaccatgttgctttaattcaagaaggaaaagatctggttacttatgcattgataaatgcaatagccattaggaagatattgaagaagtatgacaagattcatctctctactcaaggacaagctttcaagtcacaagtgcaaaggatgcacatggagatcctccagtctccatggttgtgcgagcttatcgccttccacattaatgtacgggaaacgaaggcaaactctgggaagggccatgccctttttgagggttgctctctagttgtcgatgatggcaaaccatcgctctcttgtgaactcttcgactctatcaagctagatatcgacttgacctgctctatatgcttggacacggtgtttgattcggtttctctcacttgtggccacatatactgctatatgtgtgcttgctcagctgcatctgtgacgattgttgatggactgaaagcagcagaacccaaggaaaaatgtcctttatgtcgagaggccagagtttttgaaggtgccgtacatttggatgaactcaatatattgctcagtagaagctgtccggagtattgggcggagaggcttcaaacagagagagttgaaagggttcggcaggctaaggagcactgggaatcccagtgccgagcgttcatgggcgtggaataaggcggttgccctttaaggagattgatttctctcttgcgtgtcagctatttatacagtcctgtttatagtcaaaaggatccggcaggcgaagaagcactgggaatcccagtgccgagcgtttatgggcgcggaataaggcggtttcccctttaacgagattgatttctgtcttgcatgtcagctattatacagtcctgtttatagtcctgtgatgtaataaaaagctgcattgctgaaaactttctcgccttgaacgcccctcattgttaagtctttgcgttcttgggcctgttgctctattcctttttgaacatataaacatgtacgttttcaatcaaaaaaaaa

SEQ ID NO: 258 - DNA, 2880 bp, Eucalyptus sp.
aagcaatggtatcaacgcagagtacgcgggaaaacccctccattttcttccctccccctcttaaaccctggttgcttcccgtggtgctctctctctctctctctaggcaattgggcatggcggcggcggcggcggcgtccctgccgttcaagaagaactacaggagctcccaggcgctgcagcagttctacgccggcggtcctttcgccgtctcgtccgacggctccttcatcgcgtgcaactgcggcgactccatcaagatcgtcgattcctccaacgcctccctcaggccctccatcgactgcggctccgacaccatcaccgccctctccctcagccccgacggcaagttgctcttctccgccggccacagccgccagattagggtttgggacttgtccacctccacctgcctgcgctcctggaaggggcatgatggtccggtgatgagcatggcctgccccgtctctgggggtttgctggcgacgggaggagctgataggaaagtcatggtgtgggacgtcgacggtggtttctgcacccatttcttcaaaggtcacgacggcgtcgttagcactgtcctcttccatcccgactcgaatcgctctcttctgttctctggaagtgatgatggaactatacgggtttgggatctcttggcaaagaagtgtgcttcgacactgagaggacatgattcaacagtcacttctctggctttttccgaggatggcttgacattgcttgccgctggaagagataaggttgtatctttgtgggaccttcataattatgcctgcaagaagaccatacctatgtatgaggtgcttgaatctgtatgcgtgatacatagtggaactgttttggcttcacaactggggttagacgatcagctgaaagtgacaaaagaaagtgcacagaatattcactttattactgttggtgaacgcggcattttacggatatggaaatctgaaggttcagtttgcctgtttaagcaagaacattctgatgtaactgtcatctcagatgaggacgactcaaggagtggcttcactgctgctgtcatgctacccttggatcaaggattgctatgcgtgacagctgatcaacagtttttattctattatccagagaaacatcctgaagggatattttcgctgaccctatgtagaagactcgtaggctacaatgaggaaatagttgatatgaagttcctaggagaggaggaaaatttccttgctgttgctactaatctcgaacaggtacgggtttatgaacttgcttccatgtcatgttcgtacgtcttggctggtcatactgaaactgtcctgtgccttgacacttgtatttcaagttctggaaggacgcttattgtcacgggaagtaaggacaactctgttaggttgtgggattcagaaagcagacattgcattggagttggagtaggtcacatgggcgctgtaggtgcagttgctttctcaaggaagagacaagatttttttgttagtggcagcagcgatcgtacacttaaggtttggagcttggatggcatctcagaggacggtgtagactcaacaaatttgaaagcaaaagctgttgtggcagctcatgataaagatattaattctgttgctgttgcaccaaatgacagtttagtttgttctggttctcaggatcgcacagcttgtgtttggaggcttccagacctggtatctgtagttgtacttaaagggcacaagagggggatttggtctgtagagttttcaccagttgatcaatgtgtgctcactgcatctggcgataaaacggtgaagatatgggccatatctgatggttcttgcttaaagacctttgaagggcatgtctctagtgtactaagagcatcatttctcacccgtgggacacagtttgtttcttgtggtgctgatggcttggtaaaactgtggactgttaggacaaatgaatgcattgctacatatgatcaacatagcgataaggtatgggctttggctgttggaaagaagaccgaaatgcttgctacaggtggcagtgatgctgttgtaaatctctggtacgattcaactgcttctgacaaagaggatgcttttcgtaaagaggaagaaggtgttttgaaaggtcaagagttagaaaatgcagtatctgatgctgactacaccaaggcaatcgaacttgctcttgaacttcggaggcctcataagttatttgaattgttctccgaactttgcaggacgcgagaagtaggagatcgtgtagagagaatactttctgctctcagcggcgaagaggtttgtctgcttcttgaatatatccgggagtggaatgcgaagccaaaattgtgccacgttgcccaatctgtgctatcacaagtcttcagaattctttctccaacggagatagttgagattaaaggcatcggggagctccttgaaggtctcattccatattctcagaggcatttcagcaggatagacaggcttgttagaagcacgtatttactggattacacattgacaggaatgtctgttattgaacctgaagcagacagatcagcagtcaatgatgggtctccagataaatcaggcctcgagaaactagaggatggtcttctgggagaaaatgttggtgaggagaaaatccaaaacaaggaggagctggaaagtagtgcatacaagaaaagaaaattaccgagatctaaagatcgttctaagaagaaatcaaagaatgtcgtgtacgcagatgcagcagcaatctctttcagagcttgaatacccgggtccagagttaaaaagtgtttattatgacgagcattgcagcgaggaccatgttgatgtcattcccatcctgcattctcaatgccag

SEQ ID NO: 259 - DNA, 1928 bp, Eucalyptus sp.
aagcagtggtatcaacgcagagtacgcggggaccaggaattcaatcatcccgctcctgtagaccgttgcaaatcttcctcttcacgccgcgactgctggaaaagccctctctccgcgagccaagaagagggcttttctgtccagtcttgcacgaggtcgaagatcaaggatcacccagatacggagagacagaaataagcaaaacccggaaaatggattcggctccgaggaggaagagcggcggcatcaatctcccgtccgggatgtccgagacctcgcttcggcttgacgggttctcgggttcatcatcgtctttccgggccatctccaacctgacgtccccgtccaagtcctcttccatcagcgacagattcatcccttgcagatcctcttcgaggctccacactttcgggctcgtcgaaagggggtcgccggttaaggaaggagggaacgaggcgtactcgaggttgttgaaggctgagctctttgggtctgatttcggttctctctctcctgcaggtcaagggtcgcccatgagccccagcaagaacatgttgcggttcaagaccgagagttcgggcccgaactcgccgttttcgccgtcgatcctgaggcaggacagcggtttctccagtgaagcttcgacgcctcctaagccaccaaggaaggtgcccaagacgccgcataaggttctggatgccccatcgctgcaagatgacttctatttgaatctggttgactggtcatctcagaatacgcttgcggtcgggttgggcacttgtgtttacctatggagtgcatcaaacagcaaagtgacaaagctctgtgatctgggacctaatgatggtgtctgtgcagtacagtggactcgagagggttcatacatttcaattggtaccagcctcggtcaagttcagatatgggatggaactcagtgtaagcgagttcggacaatgggtggtcatcagactagaacaggggtcttggcatggaattcgcgcatattagcttctggtagcagggaccgggtcatacttcagcatgatcttcgcgttccaaatgaattcataggcaagcttgttggccacaaatctgaggtatgtggattgaaatggtcccatgatgacagagaactcgcatcaggtgggaacgacaatcaggtaattctcgttttctggtaagtcgttttatcttccatattaaactgagtatggaatattaaacaagcttattattggttgatcagctactggtgtggaatcagcactctcagcaaccagttctgaagcttactgagcatacagcagcagtgaaagccatagcatggtctccccatcagaatgggctacttgcatcaggaggaggaactgctgatcgatgcatacgcttctggaacaccaccaatggccatcagacgagcagtgtcgacactgggagtcaggtatgtaatctggcttggagtaagaatgtcaatgagttggtgagcactcatgggtattcacagaatcaaataatggtgtggaaatatccatccatggcaaaggttgcaactctaactggccatagtcttcgagtactttatcttgccatgtctccagatggccagacaatagtgacaggagctggtgacgagaccttgcggttttggaatgtattcccatcggctaaggcaccggcaccggtcaaggatacgggtctctggtctttggggcgaacccacatcagataaaagctgcatgcttgttcaagctagctcggtctctcttgaaaagaaacatgtttgatttcattacatgtaaaaaaatcttgcacggtcaactgacattacactttttgtaaattgtgagtagaataggagaaacttttgtacaagattaatacgtgtggcataataagatttgtaaatgatctttgatcaaaaaaaaaaa

SEQ ID NO: 260 - DNA, 2582 bp, Eucalyptus sp.
ctgccatggcggtacctcgttgaaacgccgcaggacggagaagaagaagctgcaagacaactctctctctctctctctctaccttgagtgagctccggctatggaggacgaggcggagatatacgacggcgtgagagcccagttccccctcaccttcggcaagcagtccaagccccagacttccctcgaatccgtccacagcgccacccgccgcggcggccccgcccccgcccccgcccccgcctcctcctcctctcttccctctactacctccccctccgctgccggcggcgccggcaagagcagcggcctcccttctctctcctcctcctccacagcctggctcgaggggctccgggccggaaaccctagggccggccgcgaggccggaatcggctcccgcggtggcgacggtgaggacggcggtcgtgcgatgataggtccacctcgcccgccgccgggatttagcgccaatgatgatggcgggggcgaggacgacgacgacgacggcgacggggttatggttggcccgccgccgcctcctcctgggaaccttggagatggtgatgacgatgaggaggaggaagaggcgatgattgggccgccgaggccgccggttgtggattccgacgaggaggaagaagaggaagaagaggagaatcggtatcggttacctctcagcaatgagatcgtgctcaaaggccataataagatcgtatctgctcttgcggttgatcccactggttctcgggttctatccggcagttatgattacactgtacggatgttcgactttcaaggaatgaattctcgcctatcatcatttagagattttgagccagttgaaggtcatcaagtccgtaacttaagctggagtccgacggcagaccgatttctgtgcgtaactggctctgctcaagctaagatctatgatcgtgatgggcttacattaggtgaatttgtgaagggagacatgtatatccgtgatttgaaaaatactaagggccatataactggattgacttggggagagtggcaccctaaaacaaaggagacgattttaacatcatctgaggatggatctcttcgcatatgggatgtgaatgacttcaaaagtcaaaagcaggttattaaaccaaagcttgcaaggcctggaagagtacctgtgacaacatgcacttgggatcgtgagggcaaatgcattgcaggtggtattggagatggttcaatacagatctggaaccttaaacccggatggggaagcaggccggacattcatgtcgagcaagctcatgcagatgatataactgggcttaagttttccagtgatgggaaaattttactgacaagaagctttgatgattcacttaaggtgtgggatttgcgccttatgaaaaatcccctcaaagtttttgaagatcttccaaatcactatgctcagacaaatattgcatgtagtcctgacgaacagctattcttgactggaacttctgttgaaagggagtctacaattggaggcttgttgtgtttctttgatcgatctaaacttgagcttgtatcaagaattgggatttctcctacttgtagtgtcgtgcagtgtgcctggcaccccaggctgaaccagatctttgcaacttctggggataaaagccaaggaggaactcacgttctttatgatcctactctcagcgagagaggagctcttgtttgtgttgctcgtgcaccaaggaaaaaatctgtggatgactttgagttaaagcctgtcattcacaacccccatgcattgcctttgttcagggatcagccaagccgtaagcgtcaacgtgaaaagatcctcaaggatccattaaaatcccacaaaccagagcttcccatgaatggacctggacatggtggaagagttggtgcaagcaagggaagtttattgacccagtatcttcttaagcaaggaggtatgattaaggagacgtggatggatgaagatcccagagaagctatactgaagcatgctgacgctgcagaaaaaaatccaaagttcacccgtgcatatgctgaaacccagccagaccctgtttttgcaaaatctgattctgaagatgaagataaatgatgtcctatcctgcagtgcttcttttggatccttgctgctgtcattggacatgtgaggaagaaaactgggatcggactactgatacagcaagcaaatcatctgttgaccagctggagtgtcaacaaagaatgggttttctttactcaattaatttgactggtctgctgggttcaattaatcgagacatcaactccgagttcaaaatcaggaattctctaggaaagtatctcttgcattttgctggccttcttcatcatatgatgtgcagtttacattattatggttcgagtattatttagctgccctatcttaagtcatggaggctttactttgctgagaaatgtacctttagcgatgtgatgcaatagcagtctttcatatttatgtggtgtaagagatggaatcaattgtttcgcttcctcatcagatcaattaagttcatgcaactaagcttttcactgtaaaaaaaaaa

SEQ ID NO: 261 - protein, 477 aa, Eucalyptus sp.
MGDGSLGSGGRGNSGGGGGGGSRPEWLQQYDLIGKIGEGTYGLVFLARIKHPSTNRGKYIAIKKFKQSKDGDGVSPTAIREIMLLREISHENVVKLVNVHINPVDMSLYLAFDYADHDLYEIIRHHRDKVNQAINPYTVKSLLWQLLNGLNYLHSNWIIHRDLKPSNILVMGEGEEQGVVKIADFGLARVYQAPLKPLSDNGVVVTIWYRAPELLLGAKHYTSAVDMWAVGCIFAELLTLKPLFQGQEVKANPNPFQLDQLDKIFKVLGHPTQEKWPMLVNLPHWQSDVQHIQRHKYDDNALGNVVRLSSKNATFDLLSKMLEYDPQKRITAAQALEHEYFRMEPLPGRNALVPSSPGDKVNYPTRPVDTTTDIEGTTSLQPSQSASSGNAVPGNMPGPHVVTNRPMPRPMHMVGMQRVPASGMAGYNLNPSGMGGGMNPSGIPMQRGVANQAQQSRRKDPGMGMGGYPPQQKQRRF

SEQ ID NO: 262 - protein, 302 aa, Eucalyptus sp.
MEKYQQLAKIGEGTYGIVYKAKDKKSGELLALKKIRLEAEDEGIPSTAIREISLLKQLQHPNIVRLYDVVHTEKKLTLVFEFLDQDLKKYLDACGDNGLEPYTVKSFLYQLLQGIAFCHEHRVLHRDLKPQNLLINMEGELKLADFGLARAFGIPVRNYTHEVVTLWYRAPDVLMGSRKYSTQVDIWSVGCIFAEMVNGRPLFPGSSEQDQLLRIFKTLGTPSLKTWPGMAELPDFKDNFPKYVVQSFKKICPKKLDKTGLDLLSRMLQYDPAKRISAEQAMGHPYFKDLKLRKPKAAGPGP

SEQ ID NO: 263 - protein, 294 aa, Eucalyptus sp.
MDQYEKIEKIGEGTYGVVYKAIDRSTNKTIALKKIRLEQEDEGVPSTAIREISLLKEMQHGNIVKLQDVVHSERRLYLVFEYLDLDLKKHMDSCPEFSKDTHTIKMFLYQILRGISYCHSHRVLHRDLKPQNLLLDRRTNSLKLADFGLARAFGIPVRTFTHEVVTLWYRAPEILLGSRHYSTPVDVWSVGCIFAEMVNRRPLFPGDSEIDELFKIFRIMGTPNEDSWPGVTSLPDFKSTFPKWASQDLKTVTPTVDPAGIDLLSKMLCMDPRRRITAKVALEHEYFKDVGVIP

SEQ ID NO: 264 - protein, 304 aa, Eucalyptus sp.
MVMKSKLDKYEKLEKLGEGTYGVVYKAQDKTTKEIYALKKIRLESEDEGIPSTAIREIALLKELQHPNVVRIHDVIHTNKKLILVFEFVDYDLKKFLHNFDKGIDPKIVKSLLYQLVRGVAHCHQQKVLHRDLKPQNLLVSQEGILKLGDFGLARAFGIPVKNYTNEVVTLWYRAPDILLGSKNYSTSVDIWSIGCIFVEMLNQKPLFPGSSEQDQLKKIFKIMGTPDATKWPGIAELPDWKPENFEKYPGEPLNKVCPKMDPDGLDLLDKMLKCNPSERIAAKNAMSHPYFKDIPDNLKKLYN

SEQ ID NO: 265 - protein, 294 aa, Eucalyptus sp.
MDQYEKVEKIGEGTYGVVYKAIDRLTNETIALKKIRLEQEDEGVPSTAIREISLLKEMQHGNIVRLQDVVHSENRLYLVFEYLDLDLKKHMDSSPDFAKDPRLVKIFLYQILRGIAYCHSHRVLHRDLKPQNLLIDRRTNALKLADFGLARAFGIPVRTFTHEVVTLWYRAPEILLGSRHYSTPVDVWSVGCIFAEMVNQRPLFPGDSEIDELFKIFRILGTPNEDTWPGVTALPDFKSAFPKWPAKNLQDMVPGLNSAGIDLLSKMLCLDPSKRITARSALEHEYFKDIGFVP

SEQ ID NO: 266 - protein, 305 aa, Eucalyptus sp.
MEKYEKLEKVGEGTYGKVYKAKDKATGQLVALKKTRLEMDEEGVPPTALREVSLLQLLSQSLYVVRLLSVEHVDGGSKRKPMLYLVFEYLDTDLKKFIDSHRKGPNPRPVPAATVQNFLYQLLKGVAHCHSHGVLHRDLKPQNLLVDKEKGILKIADLGLGRAFTVPLKSYTHEVVTLWYRAPEVLLGSAHYSIGVDMWSVGCIFAEMVRRQALFPGDSEFQQLLHIFRLLGTPTEKQWPGVTTLRDWHVYPQWEPQNLARAVPSLGPDGVDLLSKMLKYDPAERISAKAALDHPFFDSLDKSQF

SEQ ID NO: 267 - protein, 313 aa, Eucalyptus sp.
MERPATAAVSAMEAFEKLEKVGEGTYGKVYRAREKATGKIVALKKTRLHEDEEGVPPTTLREISILRMLSRDPHIVRLMDVKQGQNKEGKTVLYLVFEYMETDLKKYIRGFRSSGESIPVNIVKSLMYQLCKGVAFCHGHGVLHRDLKPHNLLMDKKTLTLKIADLGLARAFTVPIKKYTHEILTLWYRAPEVLLGATHYSTAVDMWSVGCIFAELVTKQALFPGDSELQQLLHIFRLLGTPNEKMWPGVSSLMNWHEYPQWKPQSLSTAVPNLDKDGLDLLSQMLHYEPSRRISAKAAMEHPYFDDVNKTCL

SEQ ID NO: 268 - protein, 583 aa, Eucalyptus sp.
MGCVLGREVSSGIVTESKGRDSSEVETSKRDDSVAAKVEGEGKAEEVRTEETQKKEKVEDDQQSREQRRRSKPSTKLGNLPKHIRGEQVAAGWPSWLSDICGEALNGWIPRRANTFEKIDKIGQGTYSNVYKAKDLLTGKIVALKKVRFDNLEPESVRFMAREILILRHLDHPNVVKLEGLVTSRMSCSLYLVFEYMEHDLAGLAASPAIKFTEPQVKCYMHQLLSGLEHCHNRRVLHRDIKGSNLLIDNGGVLKIGDFGLASFYDPDHKHRMTSRVVTLWYRPPELLLGANDYGVGIDLWSAGCILAELLAGKPIMPGRTEVEQLHKIYKLCGSPSEEYWKKYKLPNATLFKPREPYRRCIRETFKDFPPSSLPLIETLLAIDPAERGTATDALQSEFFRTEPYACEPSSLPQYPPSKEMDAKKRDDEARRLRAASKGQADGSKKERTRDRRVRAVPAPEANAELQHNIDRRRLISHANAKSKSEKFPPPHQDGALGFPLGASHRFDPAVVPPDVPFTSTSFTSSKEHDQTWSGPLVDPPGAPRRKKHSAGGQRESSKLSMGTNKGRRADSHLKAYESKSIA

SEQ ID NO: 269 - protein, 706 aa, Eucalyptus sp.
MYSKSSAVDDSRESPKDRVSSSRRLSEVKTSRLDSSRRENGFRARDKVGDVSVMLIDKKVNGSARFCDDQIEKKSDRLQKQRRERAEAAAAADHPGAGRVPKAVEGEQVAAGWPVWLSAVAGEAIKGWLPRRADTFEKLDKIGQGTYSSVYKARDVTNNKIVALKRVRFDNLDTESVKFMAREIHILRMLDHPNVIKLEGLITSRMSCSLYLVFEYMEHDLTGLASRPDVKFSEPQIKCYMKQLLSGLDHCHKHGVLHRDIKGSNLLIDNNGILKIADFGLASVFDPHQTAPLTSRVVTLWYRPPELLLGASRYGVEVDLWSTGCILGELYTGKPILPGKTEVEQLHKIFKLCGSPSDDYWRRLHLPHAAVFKPPQPYRRCVAEIFKELPPVALGLLETLISVDPSQRGTAAFALRSEFFTASPLPCDPSSLPKYPPSKEIDMKLREEEARRRGAAGGKNELEKRGTKDSRTNSAYYPNAGQLQVKQCHSNANGRSEIFGPYQEKTVSGFLVAPPKQARVSKETRKDYAEQPDRASFSGPLVPGPGFSKAGKELGHSITVSRNTNLSTLSSLVTSRTGDNKQKSGPLVSESANQASRYSGPIREMEPARKQDRRSHVRTNIDYRSREDGNSSTKEPALYGRGSAGNKIYVSGPLLVSSNNVDQMLKEHDRRIQEHARRARFDKARVGNNHPQAAVDSKLVSVHDAG

SEQ ID NO: 270 - protein, 555 aa, Eucalyptus sp.
MGCIPTIISDGRRRSAAPDKRRPRPRRSSSEGEAPPHATAAGSEGGESARGAPGKERPEPAPRFVVRSPQGWPPWLVAAVGHAIGEFVPRCADSFRKLAKIGEGTYSNVYKARDLVTGKTVALKKVRFDNLEAESIKFMAREILVLTRLNHPNVIKLEGPVTSRMSSGLYLAFEYMEHDLSGIAARQNGKFTEPQVKCFMRQLLSGLEHCHNHDVLHRDIKCSNLLIDNEGNLKIADFGLATFYDPERKQVMTNRVVTLWYRAPELLLGATSYGIGIDLWSAGCILAELLYGKPIMPGRTEVEQLHKIFKLCGSPSEAYWNKFKLPNANIFKPPQPYARCIAETFKDFPPSALPLLETLLSIDPDERGTATTALNSEFFAAEPHACEPSSLPKYPPSKEMDLKLIKEKTRRDSSKRPSAIHGSRRDGIHDRAGRVIPAPEATAENQATLHRPRAMKKANPMSRSEKFPPAHMDGVVGSSANAWLSGPASNAAPDSRRHRSLNQNPSSSVGKASTGSSTTQETLKVAPELLQVGSSSLHPCHRMLVYGSNLTIRSK

SEQ ID NO: 271 - protein, 469 aa, Eucalyptus sp.
MGCICAKQADRGPASPGSGILTGAGTGTGTRSSKIPSGLFEFEKSGVKEHGGRSGELRKLEEKGSLSKRLRLELGFSHRYVEAEQAAAGWPSWLTAVAGDAIQGLVPLKADSFEKLEKIGQGTYSSVFRARELANGRMVALKKVRFDNFQPESIQFMAREISILRRLDHPNIMKLEGIITSRMSNSIYLVFEYMEHDLYGLISSPQVKFSDAQVKCYMKQLLSGIEHCHQHGVIHRDVKSSNILVNNEGILRIGDFGLANILNPKDRQQLTSHVVTLWYRPPELLMGSTSYGVTVDLWSVGCVFAELMFRKPILRGRTEVEQLHKIFKLCGSPPDGYWKMCKVPQATMFRPRHAYECTLRERCKGIATSAMKLMETFLSIEPHKRGTASSALISEYFRTVPYACDPSSLPKYPPNKEIDAKHREEARRKKARSRVREAEVGKRPTRIHRASQEQGFSSNIAPKEKRSYA

SEQ ID NO: 272 - protein, 520 aa, Eucalyptus sp.
MAVAAPGHLNVNESPSWGSRSVDCFEKLEQIGEGTYGQVYMAKEKKTGEIVALKKIRMDNEREGFPITAIREIKILKKLHHENVIKLKEIVTSPGPEKDEQGRPEGNKYKGGIYMVFEYMDHDLTGLADRPGMRFSVPQIKCYMRQLLTGLHYCHINQVLHRDIKGSNLLIDNEGNLKLADFGLARSFSNDHNANLTNRVITLWYRPPELLLGATKYGPAVDMWSVGCIFAELLHGKPIFPGKDEPEQLNKIFELCGAPDEINWPGVSKIPWYNNFKPTRPMKRRLREVFRHFDRHALELLERMLTLDPSQRISAKDALDAEYFWADPLPCDPKSLPKYESSHEFQTKKKRQQQRQHEETAKRQKLQHPPQHPRLPPVQQSGQAHAQMRPGPNQLMHGSQPPVATGPPGHHYGKPRGPSGGAGRYPSSGNPGGGYNHPSRGGQGGSGGYNSGPYPPQGRAPPYGSSGMPGAGPRGGGGNNYGVGPSNYPQGGGGPYGGSGAGRGSNMMGGNRNQQYGWQQ

SEQ ID NO: 273 - protein, 718 aa, Eucalyptus sp.
MGCICTKGILPAHYRIKDGGLKLSKSSKRSVGSLRRDELAVSANGGGNDAADRLISSPHEVENEVEDRKNVDFNEKLSKSLQRRATMDVASGGHTQAQLKVGKVGGFPLGERGAQVVAGWPSWLTAVAGEAINGWVPRRADSFEKLEKIGQGTYSSVYRARDLETNTIVALKKVRFANMDPESVRFMAREIIIMRKLDHPNVMKLEGLITSRVSGSLYLVFEYMDHDLAGLAATPSIKLTESQIKCYMQQLLRGLEYCHSHGVLHRDIKGSNLLVDNNGNLKIGDFGLATFFRTNQKQPLTSRVVTLWYRPPELLLGSSDYGASVDLWSSGCILAELFAGKPIMPGRTEVEQLHKIFKLCGSPSEEYWKKSKLPHATIFKPQQPYKRCLLETFKDFPSSALGLLDVLLAVEPECRGTASSALQNEFFTSNPLPSDPSSLPKYPSSKEFDARLRDEEARKHKATAGKARGLESIRKGSKESKVVPTSNANADLKASIQKRQEQSNPRSTGEKPGGTTQNNFILSGQSAKPSLNGSTQIGNANEVEALIVPDRELDSPRGGAELRRQRSFMQRRASQLSRFSNSVAVGGDSHLDCSREKGANTQWRDEGFVARCSHPDGGELAGKHDWSHHLLHRPISLFKKGGEHSRRDSIASYSPKKGRIHYSGPLLPSGDNLDEMLKEHERQIQNAVRKARLDKVKTKREYADHGQTESLLCWANGR

SEQ ID NO: 274 - protein, 484 aa, Eucalyptus sp.
MDPDPSPDPDPPKSWSIHTRREIIARYEILERVGSGAYSDVYRGRRLSDGLAVALKEVHDYQSAFREIEALQILRGSPHVVLLHEYFWREDEDAVLVLEFLRSDLAAVIADASRRPRDGGGGGAAALRAGEVKRWMLQVLEGVDACHRNSIVHRDLKPGNLLISEEGVLKIADFGQARILLDDGNVAPDYEPESFEERSSEQADILQQPETMEADTTCPEGQEQGAITREAYLREVDEFKAKNPRHEIDKETSIFDGDTSCLATCTTSDIGEDPFKGSYVYGAEEAGEDAQGCLTSCVGTRWFRAPELLYGSTDYGLEVDLWSLGCIFAELLTLEPLFPGISDIDQLSRIFNVLGNLSEEVWPGCTKLPDYRTISFCKIENPIGLESCLPNCSSDEVSLVRRLLCYDPAARATPMELLQDKYFTEEPLPVPISALQVPQSKNSHDEDSAGGWYDYNDMDSDSDFEDFGPLKFTPTSTGFSIQFP

SEQ ID NO: 275 - protein, 481 aa, Eucalyptus sp.
MDPDPSPSPDPPKSWSIHTRREIIARYEILERVGSGAYSDVYRGRRLSDGLAVALKEVHDYQSAFREIEALQILRGSPHVVLLHEYFWREDEDAVLVLEFLRSDLAAVIADASRRPRGGGVAPLRAGEGKRWMLQVLEGVDACHRNSIVHRDLKPGNLLISEEGVLKIADFGQARILLDDGNVAPDYEPESFEERSSEQADILQQPETMEADTTCPEGQEQGAITREAYLREVDEFKAKNPRHEIDKETSIYDGDTSCLATCTTSDIGEDPFKGSYVYGAEEAGEDAQGSLTSCVGTRWFRAPELLYGSTDYGLEVDLWSLGCIFAELLTLEPLFPGISDIDQLSRIFNVLGNLSEEVWPGCTKLPDYRTISFCKIENPIGLESCLPNCSSDEVSLVRRLLCYDPAARATPMELLQDKYFTEEPLPVPISALQVPQSKNSHDEDSAGGWYDYNDMDSDSDFEDFGPLKFTPTSTGFSIQFP

SEQ ID NO: 276 - protein, 499 aa, Eucalyptus sp.
MSNQHRRSSFSSSTTSSLAKRHASSSSSSLENAGKAFAAAAVPSHLAKKRAPLGNLTNLKAGDGNSRSSSAPSTLVANATKLAKTRKGSSTSSSIMGLSGSALPRYASTKPSGVLPSVNPSIPRIEIAVDPMSCSMVVSPSRSDMQSVSLDESMSTCESFKSPDVEYIDNEDVSAVDSIDRKTFSNLYISDAAAKTAVNICERDVLMEMETDEKIVNVDDNYSDPQLCATIACDIYQHLRASEAKKRPSTDFMDRVQKDITASMRAILIDWLVEVAEEYRLVPDTLYLTVNYIDRYLSGNVMNRQRLQLLGVACMMIAAKYEEICAPQVEEFCYITDNTYFKEEVLQMESSVLNYLKFEMTAPTVKCFLRRFVRAAQGVNEVPSLQLECMANYIAELSLLEYDMLCYAPSLVAASAIFLAKFVITPSKRPWDPTLQHYTLYQPSDLGNCVKDLHRLCFNNHGSTLPAIREKYSQHKYKYVAKKYCPPSIPPEFFHNLVY

SEQ ID NO: 277 - protein, 471 aa, Eucalyptus sp.
MNKENAVGTKSEAPTIRITRSRSKALGTSTGMLPSSRPSFKQEQKRTVRANAKRSASDENKGTMVGNASKQHKKRTVLNDVTNIFCENSYSNCLNAAKAQTSRQGRKWSMKKDRDVHQSGAVQIMQEDVQAQFVEESSKIKVAESMEITIPDKWAKRENSEHSISMKDTVAESSRKPQEFICGEKSAALVQPSIVDIDSKLEDPQACTPYALDIYNYKRSTELERRPSTIYMETLQKDVTPNMRGILVDWLVEVSEEYKLVPDTLYLTVNLIDRSLSQKFIEKQRLQLLGVTCMLIASKYEEICPPRVEEFCFITDNTYTSLEVLKMESRVLNLLHFQLSVPTVKTFLRRFVQAAQVSSEVPSVELEYLANYLAELTLVEYSFLKFLPSLMAASAVLLARWTLNQSDNPWNLTLEHYTKYKASELKAAVLALEDLQLNTSGSTLNAIREKYRQQKVNYSLLIHSKANHEIL

SEQ ID NO: 278 - protein, 434 aa, Eucalyptus sp.
MAGSDENNPGVVGGAHVQEGLRVGAGKMGAGNVQQRRALSNINSNIIGAPPYPCAVNKRVLSEKNVNSENDLLNAAHRPITRQFAAQMAYKQQLRPEENKRTTQSVSNPSKSEDCAILDVDDDKMADDFPVPMFVQHTEAMLEEIDRMEEVEMEDVAEEPVTDIDSGDKENQLAVVEYIDDLYMFYQKAEASSCVPPNYMDRQQDINERMRGILIDWLIEVHYKFELMDETLYLTVNLIDRFLAVQPVVKKKLQLVGVTAMLLACKYEEVSVPVVEDLILISDRAYSRKEVLEMERLMVNTLHFNMSVPTPYVFMRRFLKAAQSDKKLELLSFFIIELSLVEYDMLKFPPSLLAASAIYTALSTITRTKQWSTTCEWHTSYSEEQLLECARLMVTFHQRAGSGKLTGVHRKYSTSKFGHAARTEPANFLLDFRL

SEQ ID NO: 279 - protein, 486 aa, Eucalyptus sp.
MASRPIVPVQARGEAAIGGGAGKAAIGGGAGKQQKKNGAAEGRNRKALGDIGNLVTVRGIEGKVQPHRPITRSFCAQLLANAQAAAAAENNKKQAVVNVNGAPSILDVPGAGKRAEPAAAAAAAVAKAAQKKVVKPKQKAEVIDLTSDSERAIEAKKKQQHHEPTKKEGEKSSRRNMPTLTSVLTARSKAACGMTKKPKEKVVDIDAGDAHNELAAFEYIEDIYTYYKEAENESLPRNYMSSQPEINEKMRAILVDWLIEIHNKFDLMPETLYLTINIIDRFLSVKAVPRRELQLLGMGALFTASKYEEIWAPEVNDLVCIADRAYSHEQVLAMEKTILGKLEWTLTVPTHYVFLVRFIKASLGDRKLENMVYFLAELGVMNYATLTYCPSMVAASAVYAARCTLGLTPLWNDTLKLHTGFSESQLMDCARLLVGYHAKAKENKLQVVYKKYSSSQREGVALIPPAKALLCEGGGLSSSSSLASSS

SEQ ID NO: 280 - protein, 441 aa, Eucalyptus sp.
MGLPDENNAALSKPTNLQVGGLEIGGRKFGQEIRQTRRALSVINQNLVGDRAYPCHVVNKRGHSKRDAVCGKDQVDPVHRPLTRKFAAQTASTQQHCIEEAKKPRTAVQERNEFGDCIFVDVEDCQPSSENQPVPMFLEIPESRLDDDMEEVEMEDIVEEEEEEPIMDIDGRDKKNPLAVVDYIEDIYANYRRTENCSCVSANYMAQQADINEKMRSILIDWLIEVHDKFDLMHETLFLTVNLIDRFLARQSVVRKKLQLVGLVAMLLACKYEEVSVPVVGDLILISDKAYTRKEVLEMESLMLNSLQFNMSVPTPYVFMRRFLKAAESDKKLEVLSFFLIELSLVEYEMVKFPPSLLAAAAIFTAQCTLYGFKQWTKTCEWHSNYTEDQLLECARMMVGFHQKAATGKLTGVHRKYGTSKFGYTSKCEPANFLLGEMKNP

SEQ ID NO: 281 - protein, 441 aa, Eucalyptus sp.
MGLPDENNAALSKPTNLQVGGLEIGGRKFGQEIRQTRRALSVINQNLVGDRAYPCHVVNKRGHSKRDAVCGKDQVDPVHRPLTRKFAAQTASTQQHCIEEAKKPRTAVQERNEFGDCIFVDVEDCQPSSENQPVPMFLEIPESRLDDDMEEVEMEDIVEEEEEEPIMDIDGRDKKNPLAVVDYIEDIYANYRRTENCSCVSANYMAQQADINEKMRSILIDWLIEVHDKFDLMHETLFLTVNLIDRFLARQSVVRKKLQLVGLVAMLLACKYEEVSVPVVGDLILISDKAYTRKEVLEMEKLMLNSLQFNMSVPTPYVFMRRFLKAAESDKKLEVLSFFLIELSLVEYEMVKFPPSLLAAAAIFTAQCTLYGFKQWTKTCEWHSNYTEDQLLECARMMVGFHQKAATGKLTGVHRKYGTSKFGYTSKCEAANFLLGEMKNP

SEQ ID NO: 282 - protein, 412 aa, Eucalyptus sp.
MAMVQRQGHDPSSPQEQEDGPSSFLSDDALYCEEGRFEEDDGGGGGQVDGIPLFPSQPADRQQDSPWADEDGEEKEEEEAELQSLFSKERGARPELAKDDGGAVAARREAVEWMLMVRGVYGFSALTAVLAVDYLDRFLAGFRLQRDNRPWMTQLVAVACLALAAKVEETDVPLLVELQEVGDARYVFEAKTVQRMELLVLSTLGWEMHPVTPLSFVHHVARRLGASPHHGEFTHWAFLRRCERLLVAAVSDARSLKHLPSVLAAAAMLRVIEEVEPFRSSEYKAQLLSALHMSQEMVEDCCRFILGIAETAGDAVTSSLDSFLKRKRRCGHLSPRSPSGVIDASFSCDDESNDSWATDPPSDPDDNDDLNPLPKKSRSSSPSSSPSSVPDKVLDLPFMNRIFEGIVNGSPI

SEQ ID NO: 283 - protein, 388 aa, Eucalyptus sp.
MEASYQPHHHGHLRQHDPSSSQQEEQVPFDALYCSEEHWGEEDEEEGLASDGLLSEERDHRLLSPRALLDQDLLWEDEELASLFSKEEPGGMRLNLENDPSLADARREAVEWIMRVHAHYAFSALTALLAVNYWDRFTCSFALQEDKPWMTQLSAVACLSLAAKVEETQVPLLIDFQVEDSSPVFEAKNIQRMELLVLSSLEWKMNPVTPLSFLDYMTRRLGLTGHLCWEFLRRCENVLLSVISDCRFTCYLPSVIAASTMLHVINGLKPRLDVEDQTQLLGILAMGMDKIDACYKLIDDDHALRSQRYSHNKRKFGSVPGSPRGVMELCFSSDGSNDSWSVAASVSSSPEPHSKKSRAGEEAEDRLLRGLEGEEDDPASADIFSFPH

SEQ ID NO: 284 - protein, 377 aa, Eucalyptus sp.
MALQEEDTRRHYPTAPPFSPDGLYCEDETFGEDLADNACEYAGGGARDGLCEIKDPTLPPSLLGQDLFWEDGELASLVSRETGTHPCWDELISDGSVALARKDAVGWILRVHGHYGFRPLTAMLAVNYLDRFFLSRSYQRDRPWISQLVAVACLSVAAKVEETQVPILLDLQVANAKFVFESRTIQRMELLLMSTLDWRMNSVTPISFFDHILRRFGLTTNLHRQFFWMCERLLLSVVADVRLASFLPSVVATAAMLYVNKEIEPCICSEFLDQLLSLLKINEDRVNECYELILELSIDHPEILNYKHKRKRGSVPSSPSGVIDTSFSCDSSNDSWGVASSVSSSLEPRFKRSRFQDQQMGLPSVNVSSMGVLNSSY

SEQ ID NO: 285 - protein, 88 aa, Eucalyptus sp.
MGQIQYSEKYFDDTYEYRHVVLPPDVAKLLPKNRLLSENEWRAIGVQQSRGWVHYAIHRPEPHIMLFRRPLNYQQQQENQAQQNMLAK

SEQ ID NO: 286 - protein, 447 aa, Eucalyptus sp.
MGSIDPPKAEQNGTAAAAVADPGQKPGAGDAMPPPPPVKHSNGTAAEPDVATKRRRMSVLPLEVGTRVMCRWRDGKYHPVKVIERRKLNPGDPNDYEYYVHYTEFNRRLDEWVKLEQLDLNSVETVVDEKVEDKVTGLKMTRHQKRKIDETHVEGHEELDAASLREHEEFTKVKNIATIELGRYEIETWYFSPFPPEYNDCSKLYFCEFCLNFMKRKEQLQRHMKKCDLKHPPGDEIYRSGTLSMFEVDGKKNKVYGQNLCYLAKLFLDHKTLYYDVDLFLFYVLCECDDRGCHMVGYFSKEKHSEESYNLACILTLPPYQRKGYGKFLIAFSYELSKKEGKVGTPERPLSDLGLLSYKGYWTRVLLDILKKHKANISIKELSDMTAIKADDILNTLQSLDLIQYRKGQHVICADPKVLDRHLKAAGRGGLEVDVSKLIWTPYREQG

SEQ ID NO: 287 - protein, 465 aa, Eucalyptus sp.
MAQKHSTAPDPAAEPKKRRRVGFSGIDAGVDPNGCFKVYLVSREEEVGAPDSFCLDPVDLSHFFEEEDGKIYGYEGLKISVWVSCVSFHSYAEIAFESKSDGGKGITDLNTALKNMFGETLVDNKDDFLQTFSKETQFIRSTVSAGEILKHKHSDDHVNDSVSNLKVGSDVEAVRMLMGDMTAGHLYSRLVPLVLLLVDGSSPIDVTDSSWELYLLIQKTSDQQGNFHDRLLGFAAVYRFYHYPDSSRLRLGQILVLPLYQRKGYGRYLLEVLNNVAIADDVYDFTIEEPVDNLQHLRTCIDVQRLLSFDKVQQAVNSTVSQLKQGKLSKKTYIPRLLPPPSVVEDARKRFKINKKQFLQCWEILVYLGLDPADKSIQDYFSVISNRVRADILGKDSETAGKKVIEVPSDFDPEMSFVMHRAKAGGEANGIQVEDNQNKQEEQLQQLIDERLKDIKLIAEKVTQK

SEQ ID NO: 288 - protein, 465 aa, Eucalyptus sp.
MAQKHSTAPDPAAEPKKRRRVGFSGIDAGVDPNGCFKVYLVSREEEVGAPDSFCLDPVDLSHFFEEEDGKIYGYEGLKISVWVSCVSFHSYAEIAFESKSDGGKGITDLNTALKNMFGETLVDNKDDFLQTFSKETQFIRSTVSAGEILKHKHSDGHVNDSVSNLKVGSDVEAVRMLMGDMTAGHLYSRLVPLVLLLVDGSNPIDVTDSSWELYLLIQKTSDQQGNFHDRLLGFAAVYRFYHYPDSLRLRLGQILVLPLYQRKGYGHYLLEVLNNVAIADDVYDFTIEEPVDNLQHLRTCIDVQRLLSFDKVQQAVNSTVSQLKQGKLSKKTYIPRLLPPPSVVEDARKRFKINKKQFLQCWEILVYLGLDPADKSIQDYFSVISNRVRADILGKDSETAGKKVIEVPSDFDPEMSFVLHRAKAGGETNGIQVEDNQNKQEEQLQQLIDERLKDIKLIAQKVSRK

SEQ ID NO: 289 - protein, 300 aa, Eucalyptus sp.
MALPMEFWGVEVKAGQPLKVNPGNAKILHLSQASLGECKSSKGNESVPLHVKFGDQKLVLGTLSTENFPQLAFDLVFEKEFELSHNWKSGSVYFCGYKSVVHDDDDEFSDLESDSEEEDLPMIGVENGKVAAQASAKTATASANASKVESSGKQKARIPQPMKVDEDDSDEDDDDEDEDESDEEGVDGEADSDEEEDESDEEETPKKAEIGKKRAADSATKTPVPAKKSKLPTPQKTDGKKGGHTATPHPAKQAGKNPANSANKSQSPKSAGQVSCKSCSKTFNSDGALQSHSKAKHGGK

SEQ ID NO: 290 - protein, 297 aa, Eucalyptus sp.
MEFWGVEVKAGQPLKVNPGNAKILHLSQASLGECKSSKGNESVPLHVKFGDQKLVLGTLSTENFPQLAFDLVFEKEFELSHNWKSGSVYFCGYKSVVHDDDDEFSDLESDSEEEDLPMIGVENGKVAAQASAKTATASANASKVESSGKQKASIPQPMKVDEDDSDEDDDEDDDDEDESDEGVDGEADSDEEEDESDEEETPKKAEIGKKRAADSATKTPVPAKKSKLPTPQKTDGKKGGHTATPHPAKQAGKNPANSANKSQSPKSAGQVSCKSCSKTFNSDGALQSHSKAKHGGK

SEQ ID NO: 291 - protein, 307 aa, Eucalyptus sp.
MEFWGVEVKSGEPLNVEPGAETVVHLSQACLGETKEKTKESVLLYVHIGVQKLVLGTLSADKFPQIPFDLVFEKSFKLSHNWKNGSVFFSGYKTLLPCGSDADSPYSDSDTDEGLPINVTAQADVPAKKAPVTANANAAKPNLASAKQKVKIVESNEDGKNEGDDDEDADVSSDDDAEDDSGDEDMVDGGDESSDEDDDDSEEGESSEEEEPKAQPSKKRPADSVLKTPASDKKSKLETPQKTDGKKASEHVATPYPSKQAGKAIASKGQAKQQTPNSNEFSCKPCNRSFKSDQALQSHNKAKHGGS

SEQ ID NO: 292 - protein, 476 aa, Eucalyptus sp.
MDTGGNSLPSGPDGVKRKVCYFYDPEVGNYYLLQHMQVLKPVPARDRDLCRFHADDYVAFLRSITPETQQDQLRQLKRFNVGEDCPVFDGLHSFCQTYAGGSVGGAVKLNHGLCDIAINWAGGLHHAKKCEASGFCYVNDIVLGILELLKQHERVLYVDIDIHHGDGVEEAFYTTDRVMTVSFHKFGDYFPGTGDIRDIGYGKGKYYSLNVPLDDGIDDESYHSLFKPIIGKVMEVFKPGAVVLQCGADSLSGDRLGCFNLSIKGHAECVRYMRSFNVPVLLLGGGGYTIRNVARCWCYETGVALGLEVDDKMPQHEYYEYFGPDYTLHVAPSNMENKNSRQLLEEIRSKLLENLSKLQHAPSVPFQERPPDTELPEADEDQEDPDERWDPDSDMDVDEDRKPLPSRVKRELIVEPEVKDQDSQKASIDHGRGLDTTQEDNASIKVSDMNSMITDEQSVKMEQDNVNKPSEQIFPK

SEQ ID NO: 293 - protein, 499 aa, Eucalyptus sp.
MDTGGNSLPSGPDGVKRKVCYFYDPEVGNYYYGQGHPMKPHRIRMTHALLAHYGLLQHMQVLKPVPARDRDLCRFHADDYVAFLRSITPETQQDQLRQLKRFNVGEDCPVFDGLHSFCQTYAGGSVGGAVKLNHGLCDIAINWAGGLHHAKKCEASGFCYVNDIVLGILELLKQHERVLYVDIDIHHGDGVEEAFYTTDRVMTVSFHKFGDYFPGTGDIRDIGYGKGKYYSLNVPLDDGIDDESYHSLFKPIIGKVMEVFKPGAVVLQCGADSLSGDRLGCFNLSIKGHAECVRYMRSFNVPVLLLGGGGYTIRNVARCWCYETGVALGLEVDDKMPQHEYYEYFGPDYTLHVAPSNMENKNSRQLLEDIRSKLLENLSKLQHAPSVPFQERPPDTELPEADEDQEDPDERWDPDSDMDVDEDRKPLPSRVKRELIVEPEVKDQDSQKASIDHGRGLDTTQEDNASIKVSDMNSMITDEQSVKMEQDNVNKPSEQIFPK

SEQ ID NO: 294 - protein, 432 aa, Eucalyptus sp.
MRPKDRISYFYDGDVGSVYFGPNHPMKPHRLCMTHHLVLSYELHTKMEIYRPHKAYPAELAQFHSPDYVEFLHRITPDTQHLFPNDLAKYNLGEDCPVFENLFEFCQIYAGGTIDAARRLNNQLCDIAINWAGGLHHAKKCEASGFCYINDLVLGILELLKYHARVLYIDIDVHHGDGVEEAFYFTDRVMTVSFHKFGDMFFPGTGDVKEIGGKEGKFYAINVPLKDGIDDTSFTRLFKAIISKVVETYQPGAIVLQCGADSLAGDRLGCFNLSIDGHSECVRFVKKFNLPLLVTGGGGYTKENVARCWVVETGVLLDTELPNEIPENEYFKYFAPDYSLKIPRGNIVLENLNSKSYLSAIKVQVLENLRNIQHAPSVQMQEVPPDFYIPDFDEDEQNPDERMDQHTQDKQIQRDDEYYDGDNDNDHNMDDS

SEQ ID NO: 295 - protein, 601 aa, Eucalyptus sp.
MTVAEDFHVNNRSKMVSQATPESRLTGGEDDNSLHNQVDELLCQELPERQVILEFEGTRPKPYFSDHNGGENSALGVRATEDDLNSDVEAEEKQKEMTLEDMYKNDGTLYDDDEDDSDWEPVKRQVELMRWFCTNCTMVNVEDVFLCDICGEHRDSGILRHGFYASPFMQDVGAPSVEAEVQESREDHARSSPPSSSTVVGFDEKMLLHSEVEMKSHPHPERADRLQAIAASLATAGIFPGRCRSLPVREITKEELQMVHSSEHVDAVEMTSHMFSSYFTPDTYANEHSARAARIAAGLCADLASTIISGRSKNGFALVRPPGHHAGIKHAMGFCLHNNAAVAALAAQGAGAKKVLIVDWDVHHGNGTQEIFDGNKSVLYISLHRHEGGNFYPGTGAAHEVGTMGAEGYCVNIPWSRRGVGDNDYVFAFHHIVLPIASAFAPDFTIISAGFDAARGDPLGCCDVTPAGYAQMTHMLSALSGGKLLVILEGGYNLRSISSSAVAVIKVLLGDSPISEIADAVPSKAGLRTVLEVLKIQRSYWPSLESIFWELQSQWGMFLVDNRRKQIRKRRRVLVPIWWKWGRKSVLYHLLNGHLHVKTKR

SEQ ID NO: 296 - protein, 382 aa, Eucalyptus sp.
MAAAPSSPPTNRVDVFWHDGMLSHDTGRGVFDTGSDPGFLDVLEKHPENPDRVRNMVSILKRGPISPFISWHTATPALISQLLSFHSPEYINELVEADKNGGKVLCAGTFLNPGSWDAALLAAGNTLSAMKYVLDGKGKIAYALVRPPGHHAQPSQADGYCFLNNAGLAVRLALDSGCKRVVVVDIDVHYGNGTAEGFYQSSDVLTISLHMNHGSWGPSHPQSGSVDELGEDEGYGYNMNIPLPNGTGDRGYEYAVTELVVPAVESFKPEMVVLVVGQDSSAFDPNGRQCLTMDGYRAIGRTIRGLADRHSGGRILIVQEGGYHVTYSAYCLHATVEGILDLPDPLLADPIAYYPEDEAFPVKVVDSIKRYLVDKVPFLKEH

SEQ ID NO: 297 - protein, 470 aa, Eucalyptus sp.
MVESSGGASLPSVGQDARKRRVSYFYEPTIGDYYYGQGHPMKPHRIRMAHNLIVHYYLHRRMEISRPFPAATTDIRRFHSEDYVTFISSVTPETVSDPAFSRQLKRFNVGEDCPVFDGIFGFCQASAGGSMGAAVKLNRGDSDIALNWAGGLHHAKKSEASGFCYVNDIVLGILELLKVHKRVLYVDIDVHHGDGVEEAFYTTDRVMTVSFHKFGDFFPGSGHIKDTGAGPGKNYALNVPLNDGIDDESFRGMFRPIIQKVMEVYQPDAVVLQCGADSLSGDRLGCFNLSVKGHADCLRFLRSFNVPLMVLGGGGYTMRNVARCWCYETAVAVGVEPENDLPYNEYYEYFGPDYTLHVEPCSMENLNAPKDLERIRNMLLEQLSRIPHAPSVPFQMTPPITQEPEEAEEDMDERPKPRIWNGEDYESDAEEDKSQHRSSNADALHDENVEMRDSVGENSGDKTREDRSPS

SEQ ID NO: 298 - protein, 187 aa, Eucalyptus sp.
MVVPSSNPHNREMAIRRRMASTFNKREDDFPSLREYNDYLEEVEEMTFNLIEGVDVPTIEAKIAKYQEENAEQIMINRAKKAEEFAAALAASKGLPPQTDPDGALNSQAGLSVGTQGQYAPAIAGGQPRPTGMAPQPVPLGTGLDIHGYDDEEMIKLRAERGGRAGGWSIELSKKRALEEAFGSLWL

SEQ ID NO: 299 - protein, 459 aa, Eucalyptus sp.
MAAIISCHHYHSCCSSLIASKWVGARIPTSCFGRSSTQSNNAASVRQFVTRCSSSPSSRGQWQPHQNGEKGRSFSLRECAISIALAVGLVTGVPSLDMSTGNAYAASPALPDLSVLISGPPIKDPEALLRYALPINNKAIREVQKPLEDITDSLKVAGLRALDSVERNVRQASRVLKQGKNLIVSGLAESKKDHGVELLDKLEAGMDELQQIVEDGNRDAVAGKQRELLNYVGGVEEDMVDGFPYEVPEEYKNMPLLKGRAAVDMKVKVKDNPNLEECVFRIVLDGYNAPVTAGNFVDLVERHFYDGMEIQRADGFVVQTGDPEGPAESFIDPSTEKPRTIPLEIMVDGEKAPVYGATLEELGLYKAQTKLPFNAFGTMAMARDEFEDNSASSQIFWLLKESELTPSNANILDGRYAVFGYVTENQDFLADLKVGDVIESVQVVSGLDNLANPSYKIAG

SEQ ID NO: 300 - protein, 574 aa, Eucalyptus sp.
MAGEDFDIPPADEMNEDFDLPDDDDDAPVMKAGDEKEIGKQGLKKKLVKEGDAWETPDNGDEVEVHYTGTLLDGTQFDSSRDRGTPFKFTLGQGQVIKGWDQGIKTMKKGENAIFTIPPELAYGEAGSPPTIPPNATLQFDVELLSWTSVKDICKDGGIFKKILVEGEKWENPKDLDEVLVKYEFQLEDGTTIARSDGVEFTVKEGHFCPAVAKAVKTMKKGEKVLLTVKPQYGFGEKGKPASGDEGAVPPNATLQITLELVSWKTVSEVTDDKKVIKKILKEGEGYERPNEGAVVEVKLIGKLQDGTVFVKKGHDDCEELFKFKIDEEQVVDGLDKAVMNMKKGEVALLTVAPEYAFGSSESKQDLAVVPPSSTVYYEVELVSFVKDKESWDMNTEEKIEAAGKKKEEGNVIFKAGKYAKASKRYEKAVKYIEYDTSFSEDEKKQAKALKVACNLNDAACKLKLKDYNQAEKLCTKVLELDSRNVKALYRRAQAYIELSDLDLAEFDIKKALEIDPHNRDVKLEYKVLKEKVKEFNKKDAKFYGNMFAKMSKLEPVEKTAAKEPEPMSIDSKA

SEQ ID NO: 301 - protein, 502 aa, Eucalyptus sp.
MSTVYVLEPPTKGKVVLNTTHGPLDVELWPKEAPKAVRNFVQLCLEGYYDNTIFHRIIKDFLVQGGDPTGSGTGGESIYGDAFSDEFHSRLRFKHRGLVACANAGSPHSNGSQFFITLDRCDWLDRKNTIFGKITGDSIYNLSGLAEVETDKSDRPLDPPPKIISVEVLWNPFEDIVPRAPVRSLVPTVPDVQNKEPKKKAVKKLNLLSFGEEAEEEEKALVVVKQKIKSSHDVLDDPRLLKEHIPSKQVDSYDSKTARDVQSVREALSSKKQELQKESGAEFSNSFREIADDEDDDDDDASFDARMRRQILQKRKELGDLPPKPKPKSRDGISARKERETSISRDKDDDDDDDQPRVEKLSLKKKGIGSEARGERMANADADLQLLNDAERGRQLQKQKKHRLRGREDEVLTKLETFKASVFGKPLASSAKVGDGDGDLSDWRSVKLKFAPEPGKDRMTRNEDPNDYVVVDPLLEKGKEKFNRMQAKEKRRGREWAGKSLT

SEQ ID NO: 302 - protein, 262 aa, Eucalyptus sp.
MASAISMHSSGLLLLQGTNGKDVTEMGKAPASSRVANMQQRKYGATCCVARGLTSRSHYASSLAFKQFSKTPSIKYDRMVEIKAMATDLGLQAKVTNKCFFDVEIGGEPAGRIVIGLFGDDVPKTVENFRALCTGEKGFGYKGCSFHRIIKDFMIQGGDFTRGNGTGGKSIYGSTFEDENFALKHVGPGVLSMANAGPSTNGSQFFICTVKTPWLDNRHVVFGQVVDGMDVVQKLESQETSRSDVPRQPCRIVNCGELPLDG

SEQ ID NO: 303 - protein, 257 aa, Eucalyptus sp.
MAASFTALSNVGSLSSPRNGSEIRRFRPSCNVAASVRPPPLKAGLSASSSSSFSGSLRLIPLSSSPQRKSRPCSVRASAEAAAAQSKVTNKVYLDISIGNPVGKLVGRIVIGLYGDDVPQTAENFRALCTGEKGFGYKGSTVHRVIKDFMIQGGDFDKGNGTGGKSIYGRTFKDENFKLSHVGPGVVSMANAGPNTNGSQFFICTVKTPWLDQRHVVFGQVLEGMDIVRLIESQETDRGDRPRKRVVVSDCGELPVV

SEQ ID NO: 304 - protein, 188 aa, Eucalyptus sp.
MAEAIDLTGDGGVMKTIVRRAKPDAVSPSETLPLVDVRYEGVLAETGEVFDSTHEDNTLFSFEIGKGSVISAWDTALRTMKVGEVAKITCKPEYAYGSTGSPPDIPPDATLIFEVELVACKPCKGFSVTSVTEDKARLEELKKQREIAAATKEEEKKRREEAKAAAAARVQAKLDAKKGHGKGKGKAK

SEQ ID NO: 305 - protein, 172 aa, Eucalyptus sp.
MGNPKVFFDMSIGGQPAGRIVMELYADVVPRTAENFRALCTGEKGAGRSGKPLHYKGSSFHRVIPGFMCQGGDFTAGNGTGGESIYGSKFADENFVKKHTGPGVLSMANAGPGTNGSQFFVCTAKTEWLDGKHVVFGQIVDGMDVVKAIEKVGSSSGRTSKPVVVADCGQLS

SEQ ID NO: 306 - protein, 172 aa, Eucalyptus sp.
MPNPKVFFDMTIGGAAAGRVVMELYADTTPRTAENFRALCTGEKGVGRSKKPLHYKGSKFHRVIPSFMCQGGDFTAGNGTGGESIYGVKFADENFIKKHTGPGILSMANAGPGTNGSQFFICTTKTEWLDGKHVVFGKVVEGMEVVKAIEKVGSSSGRTSKPVVVADCGQLP

SEQ ID NO: 307 - protein, 188 aa, Eucalyptus sp.; identical to SEQ ID NO: 304

SEQ ID NO: 308 - protein, 203 aa, Eucalyptus sp.
MATARSFFLCALLLLATLYLAQAKKSEDLKEVTHKVYFDVEIAGKPAGRIVMGLYGKAVPKTAENFRALCTGEKGTGKSGKPLHYKGSSFHRIIPSFMLQGGDFTLGDGRGGESIYGEKFADENFKLKHTGPGLLSMANAGPDTNGSQFFITTVTTSWLDGRHVVFGKVLSGMDVVYKVEAEGRQSGTPKSKVVIADSGELPL

SEQ ID NO: 309 - protein, 225 aa, Eucalyptus sp.
MMRREISVLLQPRFVLAFLALAVLLLVFAFPFSRQRGDQVEEEPEITHRVYLDVDIDGQHLGRIVIGLYGEVVPRTVENFRALCTGEKGKSANGKKLHYKGTPFHRIISGFMIQGGDVIYGDGKGYESIYGGTFADENFRIKHSHAGIISMVNSGPDSNGSQFFITTVKASWLDGEHVVFGRVIQGMDTVYAIEGGAGTYNGKPRKKVIIADSGEIPKSKWDEER

SEQ ID NO: 310 - protein, 164 aa, Eucalyptus sp.
MWATAEGGPPEVTLETSMGSFTVELYFKHAPRTSRNFIELSRRGYYDNVKFHRIIKDFIVQGGDPTGTGRGGESIYGKKFEDEIKPELKHTGAGILSMANAGPNTNGSQFFITLAPCPSLDGKHTIFGRVCRGMEIIKRLGSVQTDNNDRPIHDVKILRTSVKD

SEQ ID NO: 311 - protein, 174 aa, Eucalyptus sp.
MSNPKVFFDILIGKMKAGRVVMELFADVTPKTAENFRALCTGEKGIGRSGKPLHYKGSTFHRIIPNFMCQGGDFTRGNGTGGESIYGMKFADENFKIKHTGLGVLSMANAGPDTNGSQFFICTEKTPWLDGKHVVFGKVIDGYNVVKEMESVGSDSGSTRETVAIEDCGQLSEN

SEQ ID NO: 312 - protein, 587 aa, Eucalyptus sp.
MDDDFEFPASSNVENDDDDGMDMDDMGGDVPEEEDPVASPAVLKVGEEREIGKAGFKKKLVKEGEGWETPSSGDEVEVHYTGTLLDGTKFDSSRDRGTPFKFKLGRGQVIKGWDEGIKTMKKGENAIFTIPPELAYGESGSPPTIPPNATLQFDVELLSWSSVKDICKDGGILKKVLVEGEKWDNPKDLDEVFVKYEASLEDGTLISKSDGVEFTVGDGYFCAALAKAVKTMKKGEKVLLTVMPQYAFGETGRPASGDEAAVPPDASLQIMLELVSWKTVSDVTKDKKVLKKTLKEGEGYERPNDGAAVQVRLCGKLQDGTVFVKKDDEEPFEFKIDEEQVIDGLDRAVKNMKKGEVALVTIQPEYAFGPTESQQDLAVVPANSTVYYEVELLSFVKEKESWEMNNQEKIEAAARKKEEGNAAFKAGKYVRASKRYEKAVRFIEYDSSFSDEEKQQAKTLKNTCNLNDAACKLKLKDFKEAEKLCTKVLEGDGKNVKALYRRAQAYIQLVDLDLAEQDIKKALEIDPNNRDVKLEYKILKEKVREYNKRDAQFYGNMFAKMNKLEHSRTAGMGAKHEAAPMTIDSKA

SEQ ID NO: 313 - protein, 361 aa, Eucalyptus sp.
MAKPRCFMDISIGGELEGRIVGELYTDVAPKTAENFRALCTGEKGIGPHTGAPLHYKGVRFHRVIKGFMVQGGDISAGDGTGGESIYGLKFEDENFDLKHERKGMLSMANSGPNTNGSQFFITTTRTSHLDGKHVVFGRVVKGMGVVRSVEHVTTAAGDCPTVDVVIADCGEIPAGADDGIRNFFKDGDTYPDWPADLDESPAELSWWMDAVDSIKAFGNGSYKKQDYKMALRKYRKALRYLDICWEKEGIDEVESSSLRKTKSQIFTNSSACKLKLCDLKGALLDAEFAVRDGENNAKAYFRQGQAHMELNDIDAAAESFSKALELEPNDVGIKKELNAAKKKIFERREQEKRAYRKMFL

SEQ ID NO: 314 - protein, 663 aa, Eucalyptus sp.
MTKRKNPLVFLDVSIDGDPVERIVIELFADTVPRTAENFRSLCTGEKGVGKTTGKPLHYKGSYFHRIIKGFMAQGGDFSNGNGTGGESIYGGKFADENFKLAHDGPGLLSMANGGPNTNGSQFFIIFKRQPHLDGKHVVFGKVMRGMEVVKKIEQVGSANGKPLQPVKIVDCGETSETGTQDAVVEEKSKSATLKAKKKRSARDSSSESRGKRRQRKSRKERTRKRRRYSSSDSYSSESSDSDSESYSSDTESESKSHSESSVSDSSSSDGRRRKRKSTKREKLRRQRGKDSRGEQKSARYDKKSRHKSADSSSDSESESSSRSRSRDDKKKSSRRESARSVSKLKDAEANSPENLESPRDREIKKVEDNSSHEEGEFSPKNDVQHNGHGTDAKFGKYDDQRPRSDGSKKSSGSMRDSPKRLANSVPQGSPSSSPAHKASEPSSSIRARNPSRSPAPDGNSKRIRKGRGFTERFSYARRYRTPSPEDVTYRPYHYGRRNFHDRRNDRYSNYRSYSERSPHRRYRSPPRGRSPPRYQRRRSRSRSVSRSPGGNKGRYRGRDQSRSRSRSRSRSPRRGSSPANKQLPLSERLKSRLGTRVDEHSPRRRRSSSRSHDSSRSRSPDEVPDKHEGKAAPVSPARSRSSSPSGRGLVSYGDASPDSGIN

SEQ ID NO: 315 - protein, 608 aa, Eucalyptus sp.
MSVLLVTSLGDIVVDLHADRCPLTCKNFLKLCRIKYYNGCVFHTVQKDFTAQTGDPTGTGTGGDSVYKFLYGDQARFFMDEIHLDLKHSKTGTVAMASGGENLNASQFYFTLRDDLDYLDGKHTVFGEVAEGLETLTRINEAYVDEKGRPYKNIRIRHTYILDDPFDDPPQLAELIPDASPEGKPKDEVVDDVRLEDDWVPLDEQLGPAQLEEAIRAKEAHSRAVVLESIGDIPDAEIKPPDNVLFVCKLNPVTEDEDLHTIFSRFGTVVSADVIRDFKTGDSLCYAFIEFENKDSCEQAYFKMDNALIDDRRIKVDFSQSVAKLWSQFKRKDSQAAKGKGCFKCGAPDHMARECPGSSTRQPLSKYILKEDNAQRGGDDSRYEMVFDEDAPESPSHGKKRRGRDDRDDRHKMSRQSVEETKFNDREGGHSVDKHRQSERSKHREDEMSRDSKASEAGRRRIDRDFPEEERDGEKYTESHRDRDGKRGDYRDYRKGRADVQTHGDRRGDENYRRKSAAYDDGHEGAGAARRKDSNDDHHAYRRGYGDSRKGTRDEDDDGRGRRDDPSYRRSSGHKDSSNGGREEQKYRSGETDGKSHPERSHRGDRRR

SEQ ID NO: 316 - protein, 227 aa, Eucalyptus sp.
MRPFNGGSSIACLVLVIAAGALAESQGPHLGSARVVFQTNYGDIEFGFFPGVAPRTVDHIFKLVRLGCYNTNHFFRVDKGFVAQVADVANGRTAPMNDEQRTEAEKTIVGEFSNVKHVRGILSMGRYDDPDSAQSSFSILLGDAPHLDGKYAIFGRVTKGDETLKKLEQLPTRREGMFVMPTERITILSSYYYDTGAESCEEENSTLRRRLAASAVEVERQRMKCFP

SEQ ID NO: 317 - protein, 172 aa, Eucalyptus sp.
MPNPKVFFDMQVGGAPAGRIVMELYADVVPKTAENFRALCTGEKGTGRSGKPLHFKGSSFHRVIPGFMCQGGDFTRGNGTGGESIYGEKFADENFVKKHTGPGILSMANAGPNTNGSQFFICTAQTSWLDGKHVVFGQVVEGLEVVRDIEKVGSGSGRTSKPVVIADSGQLA

SEQ ID NO: 318 - protein, 136 aa, Eucalyptus sp.
MRFTSITSAIALFAAAASALDKPLDIKVDKAVECSRKTKAGDKIQVHYRGTLEADGSEFDASYKRGQPLSFHVGKGQVIKGWDQGLLDMCPGEKRTLTIQPDWGYGSRGMGPIPANSVLIFETELVEIAGVAREEL

SEQ ID NO: 319 - protein, 172 aa, Eucalyptus sp.; identical to SEQ ID NO: 305

SEQ ID NO: 320 - protein, 231 aa, Eucalyptus sp.
MAVATRSRWVAMSVAWILVLFGTLALIQNRLSDTGASSDPKLVHRKVGEEKKKPDDLEEVTHKVFFDVEIGGKPAGRIVMGLFGKTVPKTVENFRALCTGEKGIGKSGKPLNYKGSQFHRIIPKFMIQGGDFTLGDGRGGESIYGNKFSDENFKLKHTDAGRLSMTNAGPDTNGSQFFITTVTTSWLDGRHVVFGKVLSGMDVVHKIEAEGGQSGQPKSIVVISDSGELDL

SEQ ID NO: 321 - protein, 106 aa, Eucalyptus sp.
MAVTLHTNLGDIKCEIFCDEVPKAAEHNARGILSMANSGPNTNGSQFFIAYAKQPHLNGLYTIFGRVIHGFEVLDIMEKTQTGPGDRPLAEIRLNRVTIHANPLAG

SEQ ID NO: 322 - protein, 231 aa, Eucalyptus sp.
MAVATRSRWVAMSVAWILVLFGTLALIQNRLSDTGASSDPKLVHRKVGEEKKKPDDLEEVTHKVFFDVEIGGKPAGRIVMGLFGKTVPKTVENFRALCTGEKGIGKSGKPLNYKGSQFHRIIPKFMIQGGDFTLGDGRGGESIYGNKFSDENFKLKHTDAGRLSMANAGPDTNGSQFFITTVTTSWLDGRHVVFGKVLSGMDVVHKIEAEGGQSGQPKSIVVISDSGELDL

SEQ ID NO: 323 - protein, 172 aa, Eucalyptus sp.; identical to SEQ ID NO: 305

SEQ ID NO: 324 - protein, 1027 aa, Eucalyptus sp.
MSPVAANAMEEAAEPEVPAPVTPSKDDADTDAAVSRFLGFCKSKLGLAEGNCVQSSTLLRKTAHVLRSSGTVIGTGTAEEAERYWFAFVLYTVRRVGERKAEDEQNGSDETEVPLSRILKASVLNLIDFFKEIPQFVIKAGAIVSGIYGANWDSRLEAREMQTNYVHLCILCKFYKRICGEFFILNDAKDDMKSADSSTSDPVIMYQPFGWLLFLALRIHALSRFKDLVSSTNALVSVLAILIIHLPTRFRKFSISDSSQLVKRSEKGVDLVGSLAYRYDTSEDEIKRTLEKANNVIAEILGITPPPASECKAENLENVDTDGLIYFGNLMEETSLSSILSTLEKIYEDATRNDSEFDERVFINDDDSLLVSGSLSGAAINLTGAKRKYDSFASPAKTITRPLSPSRSPASHINGIIGGTNLRITATPVATAMTTAKWLRTFVSPLPSKPSTDLQGFLASCDRDVTSDVIRRANIILEAIFPNSPIGERTVTGGLQNANLMDNMWAEQRRLEALKLYYRVLEAMCRAEAQILHSNNLTSLLTNERFHRCMLACSAELVLATHKTVTMLFPAVLERTGITAFDLSKVIESFVRHEETLPRELRRHLNTLEERLLENMVWERGSSMYNSLVVARPALAPEINRLGLLPEPMPSLDAIALLINFSSSGLPQSPVQKHEASPGQNGDIRSPKRISTEYRSVLVERNFTSPVKDRLLALSNIKSKLPPPPLQSAFASPTRPHPGGGGETCAETAIHIFFSKITKLAAVRINAMLERLQLSQQIKEGVYCLFQQILSQRTNLFFNRHIDQVILCCFYGVAKINQINLTFREIIYNYRKQPQCKPQVFRNVFVDWSTRRNGKAGNEHVDIISFYNEIFIPSVKPLLVELGPTGATTRTNRTSEVGNKNDAQCPGSPKISSFPTLPDMSPKKVSASHNVYVSPLRSSKMDASISHSSKSYYACVGESTHAYQSPSKDLVAINSRLNGNRKVRGTLNFDDVDAGLVSDSMVANSLYLQNGSSMSSSTAKSSEKPES

SEQ ID NO: 325 - protein, 326 aa, Eucalyptus sp.
MRPILMKGHERPLTFLKYNREGDLLFSCAKDHTPTVWFADNGERLGTYRGHNGAVWCCDVSRDSMRLITGSADTTAKLWSVQNGTQLFTFNFDSPARSVDFSIGDKLAVITTDPFMELPSAIHVKRIARDPADQASESVLVLRGHQGRIARAVWGPLNKTIISAGEDAVIRIWDSETGKLLRESDKETGHKKAVTSLMKSVDGSHFVTGSQDKSAKLWDIRTLTLIKTYVTERPVNAVTMSPLLDHVVLGGGQDASAVTMTDHRAGKFEAKFFDKILQEEIGGVKGHFGPINALAFNPDGKSFSSGGEDGYVRLHHFDPDYFNIKI

SEQ ID NO: 326 - protein, 346 aa, Eucalyptus sp.
MDKKRTVVPLVCHGHSRPVVDLFYSPITPDGFFLISASKDSSPMLRNGETGDWIGTFEGHKGAVWSCCLDTNALRAASGSADFSAKLWDALSGDELHSFEHKHIVRSCAFSEDTHLLLTGGVEKILRIFDLNRPDAPPREVDNSPGSIRTVAWLHSDQTILSSCTDIGGVRLWDVRSGKIVQTLETKSPVTSSEVSQDGRYITTADGSTVKFWDANHFGLVKSYNMPCNIESASLEPKLGNKFIAGGEDMWVHIFDFHTGEEIGCNKGHHGPVHCVRFSPGGESYASGSEDGTIRIWQTGPANNVEGDANPSNGPVTGKAKVGADEVTRKVEDLQIGKEGKDWREG

SEQ ID NO: 327 - protein, 326 aa, Eucalyptus sp.
MAEGLILKGTMRAHTDMVTAIAIPIDNSDMVVTSSRDKSIILWHLTKEEKVYGVPRRRLTGHSHFVQDVVLSSDGQFALSGSWDGELRLWDLATGVSARRFVGHTKDVLSVAFSIDNRQIVSASRDRTIKLWNTLGECKYTIQEGEAHTDWVSCVRFSPNTLQPTIVSASWDRTIKVWNLTNCKLRNTLAGHNGYVNTVAVSPDGSLCASGGKDGVILLWDLAEGKRLYNLEAGAIIHSLCFSPNRYWLCAATENSIKIWDLESKSIVEDLRVDLKNEADKTDGTTTAASNKKVIYCTSLNWSADGSTLFSGYNDGVIRVWGTGRY

SEQ ID NO: 328 - protein, 327 aa, Eucalyptus sp.
MAEGLHLKGTMKAHTDMVTAIAVPIDNADMIVTSSRDKSIILWHLTKEDKVYGVPRRRLTGHSHFVQDVVLSSDGQFALSGSWDGELRLWDLATGVSARRFVGHTKDVLSVAFSIDNRQIVSASRDRTIKLWNTLGECKYTIQEGEAHNDWVSCVRFSPNTLQPTIVSASWDRTVKVWNLTNCKLRNTLQGHSGYVNTVAVSPDGSLCASGGKDGVILLWDLAEGKKLYSLEAGAIIHSLCFSPNRYWLCAATENSIKIWDLESKSIVEDLRVDLKNEADMSDGTTGAMSSNKKVIYCTSLNWSADGSTLFSGYNDGVIRVWGIGRY

SEQ ID NO: 329 - protein, 327 aa, Eucalyptus sp.; identical to SEQ ID NO: 328

SEQ ID NO: 330 - protein, 411 aa, Eucalyptus sp.
MSGVPAPPFATTTPENGTMSSNSPAFHRDSDDDDDQGEVFLDDSDIIHEVAVDDEDLPDADDEADEAEEADDSLHIFTGHNGEVYSLACSPTDATLVATGAGDDKGFLWRIGHGDWAVELQGHKDSISSLAFSLDGQLLASGSLDGVIQIWDVPSGNLKGTLDGPGGGIEWIRWHPKGHIILAGSEDSTVWMWNADKMAYLNMFSGHGNSVTCGDFTPDGKTICTGSDDATLRIWNPKSGENIHVVKGHPYHAEGLTSMAISSDSGLAITGAKDGSVRIVNISSGRVVSSLDAHADSVEFVGLALSSPWAATGSLDQKLIIWDLQHSSPRATCDHEDGVTCLSWVGASRFLASGCVDGKVRVWDSLSGDCVRTFHGHSDAIQSLSVSANEEFLVSVSIDGTARVFEIAEFH

SEQ ID NO: 331 - protein, 347 aa, Eucalyptus sp.
MGTSQHQLSSCLQLLPRRRGNKNLIFRRTMASGGAAAVAPPPGYKPYRHLKTLTGHVAAVSCVKFSNDGTLLASASLDKTLIIWSSAALSLLHRLVGHSEGVSDLAWSSDSHYICSASDDRTLRIWSSRSPFDCLKTLRGHTDFVFCVNFNPQSSLIVSGSFDETIRIWEVKTGRCLNVIRAHSMPVTSVHFNRDGSLIVSGSHDGSCKIWDTKNGACLKTLIDDTVPAVSFAKFSPNGKFILVATLNDTLKLWNYATGKFLKIYTGHKNSVYCLTSTFSVTNGKYIVSGSEDRCICIWDLQGKNLIQKLEGHSDTVISVTCHPSENKIASAGLDSDRTVRIWLQDA

SEQ ID NO: 332 - protein, 302 aa, Eucalyptus sp.
MPSQKIETGHQDIVHDVAMDYYGKRVATASSDTTIKIIGVSNSSGSQHLASLSGHKGPVWQVAWAHPKFGSILASCSYDGQVILWKEGNQNDWAQAHVFNDHKSSVNSIAWAPHELGLCLACGSSDGNISVFTARPDGGWDTTRIEQAHPVGVTSVSWAPSMAPGALVGSGLLDPVQKLASGGCDNTVKVWKLYNGTWKMDCFPALQMHSDWVRDVAWAPNLGLPKSTIASASQDGTVVIWTVAKEGEQWQGKVLKDFKTPVWRVSWSLTGNLLAVADGNNNVTLWNEAVDGEWQQVTTVEP

SEQ ID NO: 333 - protein, 321 aa, Eucalyptus sp.
MKIAGLKSVENAHDESVWAAAWVPATESRPALLLTGSLDETVKLWRPDELALERTNAGHFLGVVSVAAHPSGVIAASASIDSFVRVFDVDTNATIATLEAPPSEVWQMQFDPKGTTLAVAGGGSASIKLWDTATWELNATLSIPRPEQPKPSEKGNKKFVLSVAWSPDGRRLACGSMDGTISIFDVARAKFLHHLEGHFMPVRSLVFSPVEPRLLFSASDDAHVHMYDSEGKSLVGSMSGHASWVLSVDVSPDGAALATGSSDRTVRLWDLSMRAAVQTMSNHSDQVWGVAFRPMAGAGVRAGGRLASVSDDKSISLYDYS

SEQ ID NO: 334 - protein, 352 aa, Eucalyptus sp.
MEIDLGNLAFDVDFHPSEQLVASGLITGDLLLYRYGDGSSPEKLLEVRAHGESCRAVRFINDGKAILTGSPDCSILATDVETGSVVARVENAHEAAVNRLVNLTESTIATGDDNGCIKVWDTRQRSCCNTFSAHEDFISDMTFASDSMKLVVTSGDGTLSVCNLRSNKVQTRSEFSEDELLSVVIMKNGRKVVCGTQSGTLLLYSWGFFKDCSDRFVDLSPSSVDALLKLDEDRIIAGTENGLISLIGILPNRIIQPIAEHSDHPIERLAFSHDKKFLGSISHDQTLKLWDLNDILGSEDSPSSQAAIDDSDSDEMDVDANPPDSSKGNKKKHSGKGNDVGNANNFFADLGD

SEQ ID NO: 335 - protein, 317 aa, Eucalyptus sp.
MSQQPSVILATASYDHTIRFWEAKSGRCYRTIQYPDSQVNRLEITPHKRYLAVAGNPSIRLFDVNSNTPQPVMSFDSHTNNVMAVGFQYDGNWMYSGSEDGTVRIWDLRARGCQREYESRGAVNTVVLHPNQTELISGDQNGNIRVWDLTANSCSCELVPEVDTAVRSLTVMWDGSLVVAANNNGTCYVWRLLRGSQTMTNFEPLHKLQAHNGYILKCLLSPEFCEPHRYLATASSDHTVKIWNVEGFTLEKTLIGHQRWVWDCVFSVDGAYLITASSDTTARLWSMSTGQDIRVYQGHHKATTCCALHDGAEGSPG

SEQ ID NO: 336 - protein, 398 aa, Eucalyptus sp.
MEDAMDMEVEVEVEAEEHSPSSSNPSGSSFRRFGLKNSIQTNFGSDYVFEITPKFDWSLMGVSLSSNAVKLYSPTTGQYCGECRGHSDTVNGISFSGPSSPHVLHSCSSDGTIRAWDTRSFKEVSCISAGPSQEIFSFSFGGSSDSLLSAGCKSQILFWDWRNKKQVACLEDSHVDDVTQVCFVPHHQNKLISASVDGLICIFDTAGDINDDEHMESVINVGTSIGKVGIFGQTFEKLWCLTHIETLSVWDWKEGTNEANFEDARKLASDSWSLDHIDYFVDCHSAEEGEGLWVIGGTNAGTLGYFPVKYKGGAAIGSPEAVLGGGHSDVVRSVLPMSGMAGTTSKTRGIFGWTGGEDGRLCCWLSDDSSATSRSWMSSNLVLKSSRSHHKKNRHQPY

SEQ ID NO: 337 - protein, 444 aa, Eucalyptus sp.
MSQHQEYPMEYAADDYDVGEVEDDMYFHERVMGDSDTDEDEEYDHLDNKITDTSAADARRGKDIQGIPWERLSVTREKYRRTRIEQYKNYENVPQSGESSEKDCKPTRKGGNYYEFWRNTRSVKSTILHFQLRNLVWSTTKHDVYLMSHFSIIHWSSLTCKKTEVLDVYGHVAPREKHPGSLLEGFTQTQVSTLAVRDKLLIAGGFQGELICKNLDRPGVSYCCRTTYDDNAITNAVEIYDYPSGAVHFMASNNDCGVRDFDMEKFELSRHFTFPWPVNHTSLSPDGKLLVIVGDNPEGIVVDSQRGKTIRPLQGHLDFSFASAWHPDGHIFATGNQDKTCRIWDIRNLSKSVAVLKGNLGAIRSIRFTSDGRFMAMAEPADFVHVYDVKSGYEKEQEIDFFGEISGVSFSPDTESLFVGVWDRTYGSLLQYNRCRNYSYLDSM

SEQ ID NO: 338 - protein, 348 aa, Eucalyptus sp.
MGASSDPNPDVSDEHQKRSEIYTYEAPWHIYAMNWSVRRDKKYRLAIASLLDHPAAAAAVPNRVEIVQLDDSTGEIRADPNLSFDHPYPATKAAFVPDKDCQRADLLATSSDFLRIWRIADDSSRVDLRSFLNGNKNSEFCRPLTSFDWNEAEPKRIGTSSIDTTCTIWDIERETVDTQLIAHDKEVYDIAWGGVSVFASVSADGSVRVFDLRDKEHSTIIYESSEPDTPLVRLGWNKQDPRYMATIIMDSAKVVVLDIRYPTMPVVELQRHQASVNAIAWAPHSSCHICTAGDDSQALIWDLSSMAQPVEGGLDPILAYTAGAEIEQLQWSSSQPDWVAIAFSLKLQ

SEQ ID NO: 339 - protein, 380 aa, Eucalyptus sp.
MRGGGGGGDATGWDEDAYRESVLKEREVQTRTVFRAAFAPSPSPSPSPDAVVVASSDGSVASYSISACLSDHRLQSLRFADAKSQNVLEAEPACFLQGHDGPAYDVKFYGEGEDSLLLSCGDDGRIRGWMWRDITSSEAHDHSQGNSAKPVLDLVNPQSRGPWGALSPIPENNALAVDVKRGSIYAAAGDSCAYCWDVECGKIKTVFKGHSDYLHCIAARNSSSQIITGSEDGTARIWDCRSGKCVQVIDPDKDHKKGFFASVSCLALDASESWLVCGRGRDLSVWSISASDCIAKISTNAPAQDVLFDDNQILLVGAEPLISRLDMNGAVLSQIHCAPQSVFSVSLHQSGVTAVGGYGGLVDVISQFGSHLCTFRCKCI

SEQ ID NO: 340 - protein, 558 aa, Eucalyptus sp.
MEAPIIDPLQGDFPEVIEEYLEHGIMKCIAFNRRGTLLAAGCTDGSCIIWDFETRGVAKELRDKECTAAITSVCWSKYGHRILVSASDKSLILWDVLSGEKIAHTTLQHTVLQACLHPGSSTPSICLACPFSSAPMIVDLNTGSTTALPVLTADVSNGATPLSRNKTSDTSVTYSPCNACFNKHGDLVYAGTSKGEILIIDHKNVRVCAIVLVSGGAVIKNVVFSRNGQYMLTNSNDRLIRIYKNLLPPKDGLKMLDELNESFNESDDVEKLKAIGSKCLELLHEFQDSITRVQWKAPCFSGDGEWVIGGAASRGEHKIYIWDRAGHLVKILEGPKEALMDLAWHPVHPIIISVSLTGLVYIWAKDYTENWSAFAPDFKELEENEEYVEREDEFDLVPETEKVKGLDVHEDDEVDVLTVERDSVFSDSDMSQEELCFLPAVPCLDIPEQQDKCVGSCSKLPDGNHSGSPLSVEAGQNGNASNHNSSPLEPMENSTADDTDGVRLKRKRKPSEKGLELQAEKVKKPVKPLKSSGRLSKTNKPVIDPDSSNGVYGDDGSD

SEQ ID NO: 341 - protein, 773 aa, Eucalyptus sp.
MRGVSWPEDGNNPSTSSSSQRNQQQAHAPRAVSGHAASHPSASNIFKLLVQREVSPRSKHSSKKLWREASKCQPYPFQQSCEAVRDVRQGLISWVESASLRHLSAKYCPLVPPPRSTIAAAFSPDGKILASTHGDHTVKLIDSQTGSCLKVLRGHRRTPWVVRFHPLYPEILASGSLDHEVRLWDANTAECIGSRNFYRPIASIAFHARGELLAVASGHKLYIWHYNRRGETSSPTIVLRTQRSLRAVHFHPHAAPFLLTAEVNDLDSADSAMTLATSPGYLHYPPPTVYFADAHSHERSRLADELPLMPLPLLMWPSFTRDDGRVPLQRIDGDVGLNGQQRVDSSSSVRLWTYSTPSGQYELLLSPVESGNSPSMPEETGNNAFSSAVEAEVSQSAMDTVEDMEVQPEERNTQFFSFSDPRFWELPLLHGWLVGQTQAGPRSVRQSSPGDIETQSAFGEVASVSPITSGVMPVSMDPSRFGGRSGSRYRSPGSRGVHVTGPNNDGPRDENDPQSVVSKLRSELAASLAAAASTELPCTVKLRIWPHDVKDPCAQLDLESCRLTIPHAVLCSEMGAHFSPCGRFLAACVACVLPHLESDPGLHGQVNQDVTGVATSPTRHPISAHQIMYELRIYSLEEATFGIVLASRPVRAAHCLTSIQFSPTSEHLLLAYGRRHSSLLKSIVIDGENTVPIYTILEVYRVSDMELVRVLPSAEDEVNVACFHPSVGGGLIYGTKEGKLRILHYDSSHGLNLKSSGFLDENVPEVQTYALEC

SEQ ID NO: 342 - protein, 438 aa, Eucalyptus sp.
MDSAVAIAALSLVVGAAIALLFFGNYFRKRRSEVVAMAEADLQPHPKNPSRPPPQPAAKKVHAKSHAHGADKDKNKRHHPLDLNTLKGHGDSVTGLCFASDGRSLATACADGVVRVFKLDDASNKSFKFLRINLPAGGHPTAVAFGDGVSSVIVASQHLSGCSLYMYGEEKPTNLDSNKQQTKLPMPEIKWEHHKVHEQKAILTLSGAAANYDSGDGSTIIASCSEGTDIIIWHAKTGKILGNVDTNQLKNTMSAISPNGRFIAAAAFTADVKVWEIVYSKDGSVKGVTKVMQLKGHKSAVTWLCFTPNSEQIVTASKDGSIRIWNINVRYHLDEDTKTLKVFPIPLQDSSGTTLHYERLSLSPDGKILAATHGSMLQWLCIETGKVLDTAEKAHDGDITCMSWAPQSIPTGDKKVNVLATASGDKKVKLWAAPPLPS

SEQ ID NO: 343 - protein, 528 aa, Eucalyptus sp.
MEVEPKKASKTFPVKPKLKPKPRTPSGKTPESKYWSSFKTTHPLDNLSFSVPSLAFSPSPPHLLAAAHSATVSLFSPHRTTISSFSDVVSSLSFRSDGQLLAASDLSGLIQVFDVRSRTPLRRLRSHARPVRFVRYPVLDKLHLVSGGDDALVKYWDVAGESVVSELRGHKDYVRCGDCSPADANCFVTGSYDHVVKLWDVRVRDGNRAATEVNHGSPVQDVIFLPSGSLVATAGGNSVKIWDLIGGGRMVYSMESHNKTVTSICVGTMGAQQSGEEGVQLRILSVGLDGYMKVFDYSRMKVTHSMRFPAPLLSIGFSPDSNVRAIGTSNGILYVGKRKAKENAEGGANGILGLGSVEEPRRRVLKPSFYRYFHRGQSEKPSEGDYLVMRPKKVKLAEHDKLLKKFQHKNALISVLGGNDPEKVVAVMEELVARRALLKCVLNLDADELGLILTFLHKNSTVPRYSSLLLGLAKKVIDLRLEDIRASDALKGHIRNLKRSVDEEIRIQEGLQEIQGMVSPLLRIAGRR

SEQ ID NO: 344 - protein, 351 aa, Eucalyptus sp.
MQGGSSGVGYGLKYQARCISDVKADTDHTSFLTGTLSLKEENEVHLLRLSSGGTELICEGLFSHPSEIWDLSSCPFDQRIFSTVFSTGESYGAAVWQIPELYGQLNSPQLEKIASLDAHSRKISCVLWWPSGRHDKLVSIDEENIFLWGLDCSKKSAQVQSQESAGMLHNLSGGAWDPHDVNTVAATCESSIQFWDLRTMKKANSLESVHARDLDYDMRKKHLLVTSEDESGVRVWDLRMPKAPIQEFPGHTHWTWAVRCNPDYEGLILSAGTDSAVNLWWSSTASSDELISERLIDSPTRKLDPLLHSYNDYEDSVYGLAWSSREPWIFASLSYDGRVVVESVKPFLSRK

SEQ ID NO: 345 - protein, 411 aa, Eucalyptus sp.
MAEEEGSAELEQQLEEEFAVWKKNTPILYDLLISHALEWPSLTVHWAPLLPQPSSSAAAAAGDPSLAAHRLVLGTHTSDGAPNFLILADALLPSSESDHCGDDAVLPKVEISQKIRVDGEVNRARFMPQNHNIVGAKTNGCEVYVFDCSKQAAKQHDGGFDPDLRLTGHDGEGYGLSWSPLKENYLLSASHDKKICLWDISAAAQDKVLGAMHVFEAHEGAVGDASWHSKNDNLFGSAGDDCQLMIWDLRTNKAQQCVKAHEKEVNSVSFNSYNDWILATASSDTTVGLFDMRKLTTPLHVFSSHEGEVLQVEWDPNHEAVLASSSEDRRVMVWDLNRIGDEQQEGDASDGPAELLFSHGGHKAKISDFSWNKNEPWVISSVAEDNSVQVWQMAESICGDDDDMQAMEGYI

SEQ ID NO: 346 - protein, 746 aa, Eucalyptus sp.
MGNYGEEDEDQYFDALEETASVSDRGSNSSDCCSSGSGLDENVLDSLGFEFWTKFPESVRARRNRFLMLTGLGIEANSVDKEDAFPPSCNEIEVYTCKVTRDDGAVQRSLDSYNCISLLQSSTSIRSNQEVESLRGDSLLSSFRGRSKESDDLTELCGMGCPESKRNAVSEFGSVSQGSIEELRRIVASSPLVHPLLHRKLEYERELIETKQKMGAGWLRKFGSATCISGRQGDTWSDPDDLEITAGMKMRRVRAHSSKKKYKELSSLYAAQEFLAHEGSISTMKFSMDGQYLASAGEDTVVRVWKVTEEDRSERVNVTVDPSCLYFALNESTQLASLNTNKEHIGKAKTFQRSSDSSCVILPLKVFQITEKPWHEFKGHNGEVLDLSWSSKGYLLSSSTDKTVRLWRVGCDRCQRVYSHNDYVTCISFNPVNENFFISGSIDGKVRIWNVFGGQVVAYIDCREIVSAVCYRSDGKGAIVGTMTGNCLFYSIKDNHLQMDAQVYLHGKKKSPGKRITGFQFPPNDPGKLMITSADSVIRVLSGLDVVCKLKGPRNSGGPMIATFTSDGKHVISASEDSNVYIWNYAGQDKTSSRVKKIWSCESFWSSNASVALPWCGIRTVPEALAPPSRSEERRASCAENGENHHMLEEYFQKMPPYSPDCFSLSRGFFLELLPKGSATWPEEKLSDTSPPTVSSQAISKLEYKFLKSACHSVLSSAHMWGLVIVTAGWDGRIRTYHNYGLPVRS

SEQ ID NO: 347 - protein, 758 aa, Eucalyptus sp.
MDIDFKEYRLRCELRGHEDDVRGVCVCGDGSIGTSSRDRTVRLWAPSAGERRKYEVARVLLGHKSFVGPLAWVPPSEELPEGGIVSGGMDTLVMAWDLRNGEAQTLKGHQLQVTGIVLDGGDIVSASVDCTLIRWKNGQLTEHWEAHKAPIQAVIRLPSGELVTGSSDTTLKLWRGKTCTQTFVGHTDTVRGLAVMPDLGILSASHDGSIRLWAVSGECLMEMVDHTSIVYSVDSHASGLIVSGSEDRFAKIWKDGVCFQSIEHPGCVWDVKFLEDGDIVTACSDGTIRIWTNQEDRMANSTELELFDLELSSYKRSRKRVGGLKLEELPGLEALQVPGTSDGQTKVIREGDNGVAYAWNSTELKWDKIGEVVDGPEDSMNRPALDGVQYDYVFDVDIGDGEPTRKLPYNRSDNPYDTADKWLLKENLPLSYRQQIVEFILANSGQRDFNLDPSFRDPYTGSSAYVPGAPSQLAAKQARPTFKHIPKKGMLVFDAAQFDGILKKINEFNNTLLSNQEKKNLSLTDIEISRLGAVVKILKDTSHYHSSKFADADFDLMLKLLESWPYEMMFPVIDIFRMVILHPDGADGLLRHQEDKKDVLMESIKRATGNPSVPANFLTSIRAVTNLFKNSAYYSWLQKHRSEMLDAFSSCSSSSNKNLQLSYATLLLNYAVLLIEKKDEEGQSQVLSAALELAENESLEVDARYRALVAIGSLMLDGLVKRIALDFDVEHIAKAARTSKEAKIAEVGADIELLIKQS

SEQ ID NO: 348 - protein, 460 aa, Eucalyptus sp.
MEFTEAYKQSGPCCFSPNARFIAVAVDYRLVIRDTLSLKVVQLFSCLDKISYIEWALDSEYILCGLYKRPMIQAWSLIQPEWTCKIDEGPAGIAYARWSPDSRHILTTSDFQLRLTVWSLVNTACVHVQWPKHASKGVSFTRDGKFAAICTRHDCKDYINLLSCHNWEIMGVFAVDTLDLADIQWSPDDSAIVIWDSPLEYKVLVYSPDGRCLFKYQAYESGLGVKSVSWSPCGQFLAVGSYDQMLRVLSHLTWKTFAEFTHLSNVRAPCCAAIFKEVDEPLQIDMSELSLSDDYMQGNSGDAPEGHYRVRYDVTEVPITLPCQKPPADRPNPKQGIGLMSWSNDSQYICTRNDSMPTILWIWDMRHLELAAILVQKDPIRAAVWDPTGTRLVLCTGSSHLYMWTPSGAYCVSVPLSQFNITDLKWNSDGSCLLLKDKESFCCAAAPLPPDESSDYSSDD

SEQ ID NO: 349 - protein, 333 aa, Eucalyptus sp.
MATIAALDDDMVRSMSIGAVFSDFVGKLNSLDFHRKDDILVTAGEDDSVRLYDIANARLLKTTFHKKHGTDRVCFTHHPNSLICSSTKNLDTGESLRYISMYDNRSLRYFKGHKQRVVSLCMSPINDSFMSGSLDHSVRMWDLRVNACQGILRLRGRPTVAYDQQGLVFAVAMEGGAIKLFDSRSYDKGPFDAFLVGGDTSEVCDIKFSNDGKSVLLSTTNNNIYVLDAYAGDKQCGFNLEPSPSTPIEASFSPDGQYVVSGSGDGTLHAWNISRRNEVACWNSHIGVASCLKWAPRRAMFVAASTVLTFWIPNSEPELASAKGEAGVPPEQV

SEQ ID NO: 350 - protein, 377 aa, Eucalyptus sp.
MSVAELKERHRAATETVNSLRERLKQKRVQLLDTDVAGYARTQGKTPVTFGATDLVCCRTLQGHTGKVYSLDWTPERNRIVSVSQDGRFIVWNALTSQKTHAIRLPCAWVMTCAFAPNGQSVACGGLDSVCSIFNLNSPVDRDGNLPVSRMLSGHKGYVSSCQYVPDGDAHLITGSGDQTCVLWDITTGLRTSVFGGEFQSGHTADVLSVSINGSSPRIFVSGSCDSTARMWDTRVASRAVHTYHGHEGDVNAVKFFPDGNRFGTGSDDGTCRLFDIRTGHELQVYYQQRGIDEIPHVTSIAFSISGRLLIAGYSNGDCFVWDTLLAQVVLNLGSLQNSHEGRISCLGVSADGSALCTGSWDTNLKIWAFGGIRRVT

SEQ ID NO: 351 - protein, 484 aa, Eucalyptus sp.
MKKRPRGASLDQAVVDIRRREVGGLSGLSFARRLAASEGLVLRLDIYNKLKGHRGCVNTVGFNLDGDIVISGSDDRHVKLWDWQTGKVKLSFDSGHLSNVFQAKIMPYTDDRSIVTCAADGQARHAQILEGGQVQTMLLAKHRGRAHKLAIDPGSPHIVYTCGEDGLVQRLDLRSNTARELFTCREVYGTHVEVVHLNAIAIDPRNPNLFVIGGSDEYARVYDIRNYKWNGSHNFGRSANYFCPSHLIGEAHVGITGLAFSGQSELLVSYNDESIYLFTQEMGLGPDPLSASTKSVDSNSSEVTSPTAVNVDDNVTPQVYKGHRNCETVKGVGFFGPKCEYVVSGSDCGRIFIWKKKGGQLIRVMAADKHVVNCIEPHPHIPALASSGIENDIKIWTPKAIERATLPMNVEQLKPKARGWMNRISSPRQLLLQLYSLERWPEHGGETSSGLAAGQEELTELFFALSANGNGSPDGGGDPSGPLL

SEQ ID NO: 352 - protein, 875 aa, Eucalyptus sp.
MSKRGYKLQEFVAHSSNVNCLSIGKKACRLFLTGGDDCKVNLWAIGKPNSLMSLCGHTNAVESVAFDSAEVLVLAGASSGVIKLWDVEEAKMVRGLTGHRSNCTAMEFHPFGEFFASGSTDTNLKIWDIRKKGCIHTYKGHTRGISTIRFSPDGRWVVSGGNDNVVKVWDLTAGKLLHDFKFHENHIRSIDFHPLEFLLATGSADRTVKFWDLETFELIGSSRPEAAGVRAIAFHPDGRTLFCGLEDSLKVYSWEPVICHDGVDMGWSTLADLCIHDGKLLGCSYYQSSVGVWVADASLIEPYGTNVKPQQKDSGDDEIEHQESRPSAKVGTTIRSTSIMRCASPDYETKDIKNIYVDTASGNPVSSQRVGTTNFAKVTQPLDFNDTPNLTLRRQGLVTETPDGLSGHVPSKSITQPKVVSRDSPDGKDSSRRESITFSRTKPGMLLRPAHSRRPSSTKYDVDRLSACAEIGVLSSAKSGSESLVDSFLNIKVAPEDGARNGCEDNHSSVKNVSVESEKVLPLQTPKTEKCDQTVGFKEEINSVKFVNGVAVVPGRTRTLVEKFEKREKLNSTEDQTINTPENPTLDKTPPPSLAENEEKSDRLNIVERKATRMSSHMVTAEDRTPVTLVGSPEDQSTVMAPQRELPADESSKTPPLPVEDLEIHHGSNVSEDKATILSSQTVSEEDSKRSTLIRNFRRRDRFKSTEGRSPVMATQRKLPTDESGKTSSLPMEDLEIKGGLNVSEDKATSFSSRAPPREDRAHSALVRNVRKRDKFKSTNDTITVMVHQRGLSTDEASTVSVERVERRQLSNNVENPLNNLPPHSVPPTTTRGEPQYVGSESDSVNHEDVTELLLGNHEVFLSTLRSRLTKLQVV

SEQ ID NO: 353 - protein, 349 aa, Eucalyptus sp.
MSTFLTGTALSNPNPNKSYEVVQPPNDSVSSLSFNPKANFLVATSWDNQVRCWEIVRSGTSLGTTPKASISHDQPVLCSTWKDDGTTVFSGGCDKQVKMWPLSGGQPMTVAMHDAPIKEISWIPEMNLLVTGSWDKTLRYWDTRQANPVHIQQLPERCYALTVRHPLMVVGTADRNLIIYNLQSPQTEFKRISSPLKYQTRCLAAFPDQQGFLVGSIEGRVGVHHLDDSQQSKNFTFKCHREGSEIYSVNSLNFHPVHHTFATAGSDGAFNFWDKDSKQRLKAMSRCSQPIPCSTFNNDGSIFAYSACYDWSKGAENHNPATAKTYIFLHLPQESEVKGKPRLGTTGRK

SEQ ID NO: 354 - protein, 475 aa, Eucalyptus sp.
MEVEAQQRDVNNVMCQLVDPEGTTLGPPMYLPQDVGPQQLQQMVNKLLSNEDKLPYTFYISDQELVVPLESYLQKNKVSVEKVLSIVYQPQAIFRIRPVNRCSATIAGHSEAVLSVAFSPDGKQLASGSGDTTVRLWDLSTQTPMFTCKGHKNWVLSIAWSPDGKHLVSGSKAGEIQCWDPLTGQPSGNPLVGHKKWITGISWEPVHLSSPCRRFVSSSKDGDARIWDVTLRRCVICLSGHTLAVTCVKWGGDGVIYTGSQDCTIKVWETSQGKLIRELKGHGHWVNSLALSTEYVLRTGAFDHTGKQYSSAEEMKQVALERYKKMKGNAPERLVSGSDDFTMFLWEPSVSKHPKTRMTGHQQLVNHVYFSPDGQWVASASFDKSVKLWNGITGKFVAAFRGHVGPVYQISWSADSRLLLSGSKDSTLKIWDIRTKKLKRDLPGHADEVFAVDWSPDGEKVVSGGKDKVLKLWMG

SEQ ID NO: 355 - protein, 453 aa, Eucalyptus sp.
MDAGSAHSSSNMKTQSRSPLQEQFLQRRNSRENLDRFIPNRSAMDFDYAHYMLTEGRKGKENPAVSSPSREAYRKQLAETLNMNRTRILAFKNKPPTPVELIPHELTSAQPAKPTKTRRYIPQTSERTLDAPDLLDDYYLNLLDWGSSNVLSIALGNTVYLWNASDGSTSELVTIDDETGPVTSVSWAPDGRHIAVGLNNSDVQLWDSADNRLLRTLRGGHRSRVGSLAWNNHILTTGGMDGLIVNNDVRVRSHIVDTYRGHTQEVCGLKWSASGQQLASGGNDNILHIWDRSTASSNSPTQWLHRLEEHTAAVKALAWCPFQGNLLASGGGGGDRTIKFWNTHTGACLNSVDTGSQVCALLWNKNERELLSSHGFTQNQLTLWKYPSMVKIAELTGHTSRVLFMAQSPDGCTVASAAGDETLRFWNVFGVPEVAKPAPKANPEPFAHLNRIR

SEQ ID NO: 356 - protein, 313 aa, Eucalyptus sp.
MEEAIPFKNLPSREYQGHKKKVHSVAWNCTGTKLASGSVDQTARVWHIEPHGHGKVKDIELKGHTDSVDQLCWDPKHADLIATASGDKTVRLWDARSGKCSQQAELSGENINITYKPDGTHVAVGNRDDELTILDVRKFKPIHKRKFNYEVNEIAWNMSGEMFFLTTGNGTVEVLAYPSLRPVDTLMAHTAGCYCIAIDPVGRYFAVGSADSLVSLWDISEMLCVRTFTKLEWPVRTISFNHTGDYVASASEDLFIDISNVQTGRTVHQIPCRAAMNSVEWNPKYNLLAYAGDDKNKYQADEGVFRIFGFESA

SEQ ID NO: 357 - protein, 424 aa, Eucalyptus sp.
MGKDEEEMRGEIEERLINEEYKVWKKNTPFLYDLVITHALEWPSLTVEWLPDREEPPGKDYSVQKLVLGTHTSENEPNYLMLAQVQLPLEDAENDARHYDDDRADVGGFGCANGKVQIIQQINHDGEVNRARYMPQNSFIIATKTVSAEVYVFDYSKHPSKPPLDGACSPDLRLRGHSTEGYGLSWSKFKQGHLLSGSDDAQICLWDINATPKNKSLDAMQIFKVHEGVVEDVAWHLRHEYLFGSVGDDQYLLIWDLRTPSVTKPVQSVVAHQSEVNCLAFNPFNEWVVATGSTDKTVKLFDLRKISTALHTFDAHKEEVFQVGWNPKNETILASCCLGRRLMVWDLSRIDEEQTPEDAEDGPPELLFIHGGHTSKISDFSWNTCEDWVVASVAEDNILQIWQMAENIYHDEDDVPGEESNKGS

SEQ ID NO: 358 - protein, 770 aa, Eucalyptus sp.
MMRGFSCTEDGDAPSTSSTSPPPPPPPPHRQQMQAPRASSSSSGQPTSRRSTGNVFKLLARREVSPRSKHSLKKFWGEASECQLCPFQQSYEAVRDVRRSLISWVEAFSLQHLSAKYCPLMPPPRSTIAAAFSPDGKILASTHGDHTVKLIDSQTGSCLKVLRGHRRTPWVVRFHPLYPEILASGSLDHEVHLWDANTAECIGSRNFYRPIASIAFHAQGDLLAVASGHKLYIWHYNRSGETSSPTIVLRTPRSLRAVHFHPHAAPFLLTAEVNDLDLTDSAMTLATSPGYLHYPPPTIYLADAHSNERSRLEDELPLMPSPLLMWPSFTRDDGRATLPHIGGDVGLSGQQRVDSLSSGQYEFHPSPIEPSSSTSMHEEMGTDPFSSVRESEVTQSAMNIVDNTEVQPEERSTYSFSFSDPRFWELPSVYGWLVGQTQAAPRTAPSPGALETASALGEVASVSPVRSEFMPGGMDQPRLGGRSGSGCRSSGSRMMRTAGLNDHPHDENYPQSVVSKLRSELEASLAAAASTELPCTVKLRVWPYDMKDPCALFRSESCRLTIPHAVLCSEMGAHFSPCGRFFAACVACVLPQLEADPVLHGQVDPDVTGVATSPTRHPVSAYQIMYELRIYSLEEATFGMVLASRSIRAAHCLTSIQFSPTSEHLLLAYGRRHNSLLKSIVIDGENTVPIYSILEVYRVSDMELVRVLPSAEDEVNVACFHPSVGGGLVYGTKEGKLRILQIDSSGGLNPKSTGFLDENMAEVPTYALEC

SEQ ID NO: 359 - protein, 299 aa, Eucalyptus sp.
MGEGDLPRTEAGVLRGHEGAVLAARFNGDGNYCLSCGKDRTIRLWNPHRGIHIKTYKSHGREVRDVHCTSDNSKLISCGGDRQIFYWDVSTGRVIRRFRGHDSEVNAVKFNDYASVVVSAGYDRSVRAWDCRSHSTEPIQIINTFQDSVMSVCLTKTEIIGGSVDGTVRTFDIRIGREISDDLGQPVNCISMSNDGNCILASCLDSTLRLVDRSAGELLQEYKGHTCKSYKLDCCLTNTDAHVAGGSEDGYVFFWDLVDASVISKFRAHSSVVTSVSYHPKEDCMITASVDGTIKVWKT

SEQ ID NO: 360 - protein, 1125 aa, Eucalyptus sp.
MACIKGVGRSASVAMAPDGGYLATGTMAGTVDLSFSSSASLEIFGLDFQSDDRDLPLIAESPSSERFNRLSWGKNGSGSDEFSLGLIAGGLVDGTIGLWNPLSLIRSEAGDKAIVGHLSRHKGPVRGLEFNVIAPNLLASGADDGEICIWDLAAPREPSHFPPLRGSGSAAQGEISFLSWNSKVQHILASTSYNGTTVVWDLKKQKPVISFSDSVRRRCSVLQWNPDLATQLVVASDEDSSPTLRLWDMRNIMSPVKEFAGHTRGVIAMSWCPNDSSYLVTCAKDNRTICWDTVTGEIVCELPAGSNWNFDVHWYPKIPGVISASSFDGKIGIYNVEGCSRYGVRENEFGAATLRAPKWFKRPVGASFGFGGKVVSFHTRSTGGPSVNSSEVFVHDIITEQTLVSRSSEFEAAIQSGDRPSLRALCEKKSQHCESTDDQETWGFLKVLLEDDGTARSKLLAHLGFDIPTETNDGSQEDLSQQVNALGLEDVTADKVVQEDNNESMVFPTDNGEDFFNNLPSPRADTPVSTSADGFPTVNAAVEPSQDEVDGLEESSDPSFDDSVQRALVVGDYKAAVALCMSANKLADALVIAHVGGASLWESTRDKYLKMSRLPYLKVVFAMVNNDLQSLVDTRPLKFWKETLAILCSFAQGEEWAMLCNSLASKLMAAGNMLAATLCFICAGNIDKTVEIWSRSLATEHDGMSYMDLLQDLMEKTIVLALASGQKQFSASVCKLVEKYAEILASQGLLTTAMDYLKLLGTDDLSPELAVLRDRIAFSVEAEKGANISAFNGSQDPRGAVYGVDQSNYGMVDTSQHYYPEAAQPQVPHTVPGSPYGENYQQPFGSSFGKGYNTPMQYQAPSQASMFVPSEPPQNAQPSFVPTPVTSQPTTRSQFIPAPPLALRNPEQYQQPTLGSHLYPGSVNPTFQPLPHAPGPVAPVPPQVSSVPGQNMPQAVAPTQMRGFMPVTNPGVVQNPGPISMQPATPIESAAAQPVVSPAAPPPTVQTADTSNVPAPQKPVIATLTRLYNETSEALGGSRANPAKKREIEDNSRKIGALFAKLNSGDISKNAADKLVQLCQALDNGDYSTALQIQVLLTTSEWDECNFWLATLKRMIKTRQNVRLS

SEQ ID NO: 361 - protein, 467 aa, Eucalyptus sp.
MKERGKGAGRSVDERYTQWKSLVPVLYDWLANHNLVWPSLSCRWGPQLEQATYKNRQRLYLSEQTDGSVPNTLVIANVEVVKPRVAAAEHISQFNEEARSPFVKKFKTIIHPGEVNRIRELPQNSKIVATHTDSPDVLIWDVETQPNRHAVLGASTSRPDLILTGHKDNAEFALAMSPTEPFVLSGGKDRYVVLWSIQDHISTLAADPGSAKSPGSAGTNNKQSSKAAGGNDKTGDSPSIEPRGVYLGHGDTVEDVTFCPSSAQEFCSVGDDSCLILWDARTGSSPAIKVEKAHHADLHCVDWNPHDVNLILTGSADNTVRMFDRRNLTSGGVGSPVHTFEGHNAAVLCVQWSPDKSSVFGSSAEDGILNIWDHEKIGRKIETVGSKVPNSPPGLFFRHAGHRDKVVDFHWNSSDPWTIVSVSDDGESTGGGGTLQIWRMIDLIYRPEEEVLAELDKFKSHILSCTS

SEQ ID NO: 362 - protein, 372 aa, Eucalyptus sp.
MAKIAPGCEPVAGTLTPSKKREYRVTNRLQEGKRPLYAVVFNFIDSRYFNVFATVGGNRVTVYQCLEGGVIAVLQSYIDEDKDESFYTVSWACNIDRTPFVVAGGINGIIRVIDAGNEKIHRSFVGHGDSINEIRTQPLNPSLIVSASKDESVRLWNVHTGICILIFAGAGGHRNEVLSVDFHPSDKYRIASCGMDNTVKIWSMKEFWTYVEKSFTWTDLPSKFPTKYVQFPVFIAPVHSNYVDCNRWLGDFVLSKSVDNEIVLWEPKMKEQSPGEGSVDILQKYPVPECDIWFIKFSCDFHYHSIAIGNREGKIYVWELQSSPPVLIAKLSHPQSKSPIRQTAMSFDGSTILSCCEDGTIWRWDAITASTS

SEQ ID NO: 363 - protein, 491 aa, Eucalyptus sp.
MNTAMHFGAGWRSIAEMGYTMSRLEIEPESCEDEKSLDGVGNSQGPNELPRCLDHELAHLTNLKSRPHEHLIRDFPGRRALPVSTVKMLAGRECNYSRRGRFSSADCCHMLSRYVPVNGPSPLDQMNSRAYVSQFSADGSLFVAGFQGSHIRIYNVDKGWKCQKNILTKSLRWTITDTSLSPDQRYLVYASMSPIVHIVDIGSAAMDSLANITEIHEGLDFSADSGPYSFGIFSVKFSTDGREVVAGSSDDSIYVYDLVANKLSLRIPAHESDVNTVCFADESGHIIYSGSDDTYCKVWDRRCLSARNKPAGVLMGHLEGITFIDSRGDGRYFISNGKDQTIKLWDIRKMGSDICRRGFRNFEWDYRWMDYPPRARDSKHPFDLSVATYKGHSVLRTLIRCYFSPVHSTGQKYIYTGSHDSCVYIYDVVTGAQVAALKHHKSPVRDCSWHPEYPMIVSSSWDGDIVKWEFFGNGETEIPAMKKRIRRRHLY

SEQ ID NO: 364 - protein, 518 aa, Eucalyptus sp.
MEPQPQAPKKRGRKPKPKEDKKEEQLHQPPPPPPPQQQAAPAPAPAATRSSTSGSAGGRDRRPQQQHAVDEKYARWKSLVPVLYDWLANHNLLWPSLSCRWGPQLEQATYKNRQRLYISEQTDGSVPNTLVIANCEVVKPRVAAAEHVSQFNEEARSPFIRKYKTIIHPGEVNRVRELPQNPNIVATHTDSPDVLIWDVESQPNRHAVYGATASRPNLILTGHQENAEFALAMCPAEPFVLSGGKDKTVVLWSIQDHITASATDQTTNKSPGSGGSIIKKTGEGNEETGNGPSVGPRGIYCGHEDTVEDVAFCPSTAQEFCSVGDDSCLILWDARVGTNPVAKVEKAHNGDLHCVDWNPHDNNLILTGSADNSVNMFDRRNLTSNGVGSPVYKFEGHKAAVLCVQWSPDKPSVFGSSAEDGLLNIWDYERVDKKVDRAPNAPAGLFFQHAGHRDKIVDFHWNAADPWTMVSVSDDCDTAGGGGTLQIWRMSDLIYRPEEEVLAELENFKAHVLECSKA

SEQ ID NO: 365 - protein, 913 aa, Eucalyptus sp.
MGIFEPYRAVGYITTGVPFSVQRLGTETFVTVSVGKAFQVYNCAKLSLVLVGPQLPKKIRALASYREYTFAAYGSDIGIFKRAHQLATWSGHTAKVCLLLLFGEHILSVDVDGNAYIWAFKGMNYNLSPVGHILLDSNFTPSCIMHPDTYLNKVILGSQEGPLQLWNISTKTKLYEFKGWNSSVSSCVSSPALDVVAVGCADGKIHVHNIRYDEELVTFSHSMRGSVTALSFSTDGQPLLASGSSSGVVSIWNLDKRRLQSVIRDAHDGSIISLHFFANEPVLMSSSADNSIKMWIFDTSDGDPRLLRFRSGHSAPPLCIRFYANGRHILSAGQDRAFRLFSVVQDQQSRELSQRHVSKRAKKLKLKEEEIKLKPVIAFDVAEIRERDWCNVVTSHMDTPQAYVWRLQNFVIGEHILRPCPNKPTPVKACMISACGNFAILGTAGGWIERFNLQSGISRGSYIDQLEGTNSAHDGEVVGVACDATNTLMISAGYAGDIKVWDFKGRELKSRWEIGSSLVKISYHRLNGLLATVADDFIIRLFDAVALRMVRKFEGHTDRITDLCFSEDGKWLLSSSMDGSLRIWDIILARQVDAVFVDVSITALSLSPNMDILATTHVDQNGVFLWVNQSMFSGDSDINLYASGKEVVTVKLPSVSSVEGSQVEESNEPTIRHSESKDVPSFRPSLEQIPDLVTLSLLPKSQWQSLINLDIIKVRNKPVEPPKKPEKAPFFLPSIPSLSGEILFKPSEMSDKGDMKADEDKSKITPEVPSSRFLQLLHSCSEAKNFSPFTTYIKGLSPSTLDLELRMLQIIDDDAVDADADDPQDVDKRQELLSIELLMDYFIHEISCRSNFEFVQALVRLFLKIHGETIRRQSVLQNKAKVLLETQCSVWQRVDKLFQGARCMVAFLSNSQF

SEQ ID NO: 366 - protein, 390 aa, Eucalyptus sp.
MEETKVTCGSWIRRPENVNLAVLGRSPRRRGSAALEIFAFDPKSTSLSSSPLVAHVIEEIEGDPLAIAVHPNGEDIVCFASSGSCLSFELSGQESNLKLLTKELPPLRGIGPQKCMAFSVDGSRFATGGVDGRLRILEWPSLRIILDEPKAHKSIRDLDFSLDSEFLATTSTDGSARIWKAEDGLPCTTLTRRSDEKIELCRFSKDGTKPFLFCTVQRGDKAVTGVWDISTWNKIGHKRLLRKPAVVMSISLDGKYLAQGSKDGDMCVVEVKKMEVSHWSKRLHLGTSLTSLEFCPIERVVITTSDEWGVLVTKLNVPADWKAWQVYLLLLGLFLASLVAFYIFYENSDSFWGFPLGKDQPARPKIGSVLGDPKSADDQNMWGEFGPLDM

SEQ ID NO: 367 - protein, 1425 aa, Eucalyptus sp.
MADPVEHQHQQHQQHQLQQQRRRGWRIQGGQYLGEISALCFLHLPPPPLSLSSSPVLSLSSGLDSESRDRPACSFRFPSAGSGSQVSLFDLASGAMVRTFYVFRGIRVHGIVLGCADFPGGSSSSSSTLDYVIAVYGERRVKLFRLSVRLGRGAGEGSGTVLSADLELVSAAPRLSHWVMDVRFLKENGTSEDELQRCLTVAIGCSDNSIRLWDVDKCSFVLAVSSPERCLLYSMRLWGDNLEDLQVASGTIYNEILIWKVVPNHDAPSSNELTEEGLTNSCAGNSVHECLRYEAYHICRLVGHEGSIFRIAWSSDGSKLVSVSDDRSARIWEVHCKVQYSEDAGEVGLLFGHSARVWDCYISDNLIVTAGEDCSCRVWGLDGQQHDVIKEHIGRGIWRCLYDPWSSLLVTGGFDSAIKVHKLDASLAEASAKQSNIKDLSDGTELFTTHLPNSSGHSGHMDSKSEYVRCLSFSCEDVMYIATNHGYLYHAKLCNDGDLRWTELAQVSNEVQIICMELLPSNPYDPRIDADDWVAVGDGKGWTTVVRVVKNSDSPKVSTSFSWAAEMDRQLLGIHWCKSLGHRFIFTADPRGALKLWRFFEVSQSSSLYPENSPRISLIAEFKSDLGARIMCLDVAFESELLICGDLRGNLVLFPLLKDLLLDTFVVSAAKISPVNHFKGAHGISAVSSISVAHMSFNHIELRSTGADGCICYMEYDKGLQSLNFVGMKQVKELSMIESVSTENESTGYRTSGSYASGFASTDFIIWNLVTEAKVLQVSCGGWRRPHSYYLGDVPEMKNCFAYVKDDIIYIRRHWIKDSKDKILPQNLRLQFHGREVHSLCFVTGDFQLRKNKQSSWIVTGCEDGTVRLTRYTQCTDNWSSSKLLGEHVGGSAVRSICCVSNIHTTSSGTSVSDVKGIENLPKDIKGTLMEDECNPSLLISVGAKRVLTSWLLRRRKQDGKEDDVTDLQEAENSSLPSSAGSSTFSFQWLSTDMPVKYSVPSKKSGSIKKLIGVSDTNVRCKSLLPDSEALQSKVSAVDKNEDDWRYLAVTAFLVRHSGSRLIVCFIIVACSDATLAIRALVLPYRLWFDVALMVPLSSPVLSLQHVIIGRCQLPDENVQIGNVYVVISGATDGSIAFWDLTESVEAFMRRLSNIHLEKFMDCQKRPRTGRGSQGGRWWRSLSKIACKEQPINDPVTAKAIKELNRKLTGGVACGSSSSMLDASPELDSNAANSSFEIIEVNPFHVLNGVHQSGVNCLHVCETKHGQSSDGRFLYQLVSGGDDQALHLLKFEVLVQPPVQVPDVPNSDIRNSILVEEFLLDEQNQKTKCTIEFISQEKIASAHNSAVKGVWTDGTWVFSTGLDQRVRCWISKDRGTPTELAHFIISVPEPEALDARSICWDQYQIAVAGRGMQMIEFHVPSSEIR

SEQ ID NO: 368 - protein, 793 aa, Eucalyptus sp.
MPYKLSATLSNHSSDVRAVASPSDDLILSASRDSTAISWFRQSPSSFTPASVIRAGSRFVNAIAYLPPTPRAPQGYAVVGGQDTVVNVFALGPGDKEEPEYTLVGHTDNVCALSVNSDDTIISGSWDKTAKVWKDFALVYDLKGHQQSVWAVLAMNEKEFLTASADRTIKYWVQHKTMQTYEGHRDAVRGLALIPDIGFASCSNDSEIRVWTMGGDVVYTLSGHTSFVYSLSVLPNGDLVSAGEDRSVRVWRDGECSQVIVHPAISVWAVSTMPNGDIISGSSDGVVRVFSESEKRWATASELKALEDQIASQSLPSQQVGDVKKTDLPGPEALSVPGKKAGEVKMIRSGDVVEAHQWDSLASSWQKIGEVVDAIGSGRKQLHDGKEYDYVFDVDIQEGAPPLKLPYNVSENPYTAAQRFLEQNDLPTGYLDQVVKFIEQNTAGVKLGNDGYVDPFTGASRYQPATQSTSNTASSSYMDPFTGGSRHIAESAPSNVPQGSHATGIIPFSKPIFFKLANVSAMQAKMFQFDEVLRNEISTATLAMRPDEVIMVNETFTYLSKVVTSTSSARTSLGWIHIETIMQILDRWPVPQRFPVIDLGRLVTAYCMNAFSGPGDLEKFFSCLFRTSEWTSITSGSKALTKAQETNVLLLFRTIANSLDGAPLNDMEWIKQIFRELAQTPQLVLNKSHRLALASVLFNFSCIGLKGPVPADVRTLHLTIILQVLRSPNDDPEVAYRTCVALGNMLYSDKTRGTPRDAQSPSPTELKSAVAAIKGGFSDPRINDVHREIMSLI

SEQ ID NO: 369 - protein, 301 aa, Eucalyptus sp.
MPPQKIESGHKDTVHDLAMDYYGKRLATASSDHTINVVGVSSSGSQHLATLIGHQGPVWQISWAHPKFGSLLASCSYDGRVIIWREGNPNEWTQAQVFEEHKSSVNSVAWAPHELGLCLACGSSDGNISVFTARQDGGWDTSRIDQAHPVGVTSVSWAPSTAPGALVGSGMMEPVQKLCSGGCDNTVKVWKLYNRVWKLDCFPVLQMHTDWVRDVAWAPNLGLPKSTIASASQDGRVIIWTLAKEGDQWQGKVLYDFRTPVWRVSWSLTGNILAVADGNNNVSLWNEAVDGEWIQVSTVEP

SEQ ID NO: 370 - protein, 515 aa, Eucalyptus sp.
MSAPMLEIEARDVVKIVLQFCKENSLHQTFQTLQSECQVSLNTVDSIETFVADINSGRWDAILPQVAQLKLPRNTLEDLYEQIVLEMIELRELDTARAILRQTQAMGVMKQEQPERYLRLEHLLVRTYFDPNEAYQDSTKEKRRAQIAQALAAEVTVVPPSRLMALVGQALKWQQHQGLLPPGTQFDLFRGTAAMKQDVDDMYPTTLSHTIKFGTKSHAECARFSPDGQFLVSCSVDGFIEVWDYMSGKLKKDLQYQADETFMMHDDPVLCVDFSRDSEMLASGSQDGKIKVWRIRTGQCLRRLERAHSQGVTSVLFSRDGSQLLSTSFDGSARIHGLKSGKQLKEFRGHSSYVNDAIFSNDGSRVITASSDCTVKVWDVKTSDCLQTFKPPPPLRGGDASVNSVHLFPKNADHIVVCNKTSSIYIMTLQGQVVKSLSSGKREGGDFVAACVSPKGEWIYCVGEDRNLYCFSCQSGKLEHLMKVHEKDVIGVTHHPHRNLVATYSEDSTMKLWKP

SEQ ID NO: 371 - protein, 523 aa, Eucalyptus sp.
MDLLQSYAEDNDGDLGRHSSPEPSPPRLLPSKSAAPKVDDTTLALTVAQTNQTLARPIDPSQHAVAFNPTYDQLWAPICGPAHPYAKDGIAQGMRNHKLGFVEDAAIGSFLFDEQYNTFQRYGYAADPCASTGNEYVGDLDALKQNDGISVYNIRQQEQKKYAEEYAKKKGEERGEGGREKAEVVSDKSTFHGKEERDYQGRSWIAPPKDAKATNDHCYIPKRLVHTWSGHTKGVSAIRFFPKHGHLILSAGMDTKVKIWDVFNSGKCMRTYMGHSKAVRDISFCNDGTKFLTAGYDKNIKYWDTETGKVISTFSTGKIPYVVKLHPDDEKQNILLAGMSDKKIVQWDMNTGQITQEYDQHLGAVNTITFVDDNRRFVTSSDDKSLRVWEFGIPVVIKYISEPHMHSMPSISLHPNTNWLAAQSLDNQILIYSTRERFQLNKKKRFAGHIVAGYACQVNFSPDGRFVMSGDGEGRCWFWDWKSCKVFRTLKCHEGVCIGCEWHPLEQSKVATCGWDGLIKYWD

SEQ ID NO: 372 - protein, 438 aa, Eucalyptus sp.
MESNGNLEQTLQDGRIYRQLNSLIVAHLRDHNFPQAASAVALATMTPLNVEAPRNRLLELVAKGLAVEKGELLRGVSHAGTNDLGGSIPASYGLVPAPWTAIDFSSLRDTKGMSKSFTKHETRHLSDHKNVARCARFSTDGRFFATGSADTSIKLFEVSKIKQMMLPDSTDGAIRAVIRTFYDHTHPVNDLDFHPQNTVLISAAKDHTVKFFDYSKATAKRAFRVIQDTHNVRSVAFHPSGDFLLAGTDHPIPHLYDVNTFQCYLSANVPEFAVNAAINQVRYSSSGGMYVTASKDGTIRFWDGASANCVRSIAGAHGAAEVTSANFTKDQRYVLSCGKDSTVKLWEVGTGRLVKQYLGATHMQLRCQAVFNNTEEFVLSIDEPSNEIVVWDAMTAEKVARWPSNHNGPPRWIEHSPTEAAFVSCGTDRSIRFWKETH

SEQ ID NO: 373 - protein, 442 aa, Eucalyptus sp.
MSNFQGEDGEYVADDFEAEDGDEELHGRESADPESDVDEIDTPSNRFTDTTADQARRGRDIQGIPWERLSITREKYRRTRLEQYKNYENVPQSGEKSGKDCTVTEKGNSFYEFRRNSRSVKSTILHFQLRNLVWATSKHDVYLMSNYSVVHWSSLTGKKSEVLNLAGHVAPNEKHPGSLLEGFTQTQVSTLAVKDRFLVAGGFQGELICKFLDRPGISFCSRTTYDDNAITNAVEIYVSPSGGIHFIASNNDCGVRDFDMENFELSKHFRFPWPVNHTSLSPDGKLLVIVGDDPEGILVDAKTGKTIMPLRGHLDFSFASEWHPDGVTFATGNQDKTCRIWDIRNLSKSIAVLKGNLGAIRSIRYTSDGRYMAIAEPADFVHVYDTKTGYKKEQEIDFFGEISGMSFSPDTESLFIGVWDRTYGSLLEYGRRRNFSYLDCLV

SEQ ID NO: 374 - protein, 575 aa, Eucalyptus sp.
MGVEEDLEDLNALAESTDAAVDGQAALASAVDSVTLQPAPPILPPVIPPPAVPVVAPVPTIPPVLRPLAPLPIRPPVLRPPAPKRDEAGSSDSDSDHDGTAAGSTAEYEITEESRLVRERHEKAMQDLMMKRRGAALAVPTNDKAVRARLRRLGEPMTLFGEREMERRDRLRMLMAKLDAEGQLEKLMKAHEDEEAAASAAPEDVEEEMLQYPFYTEGSKALFNARIDIAKFSITRAALRLERARRRRDDPDEDVDAEIDWALKKAESLSLHCSEIGDDRPLSGCSFSHDGKLLATCSMSGVAKLWDTCRMPQVNRVLTLKGHTERATDVAFSPVQNHIATASADRTAKLWNTEGTILKTFEGHLDRLGRIAFHPSGKYLGTTSFDKTWRLWDIESGEELLLQEGHSRSIYGIDFHRDGSLVASCGLDALARVWDLRTGRSILALEGHVKPVLGVSFSPNGYHLATGGEDNTCRIWDLRKKKSLYTIPAHANLISEVKFEPQEGYFLVTASYDTTAKVWSARDFKPVKTLSVHEAKITSVDITADASHIVTVSHDRTIKLWTSNDDVKEQAMDVD

SEQ ID NO: 375 - protein, 946 aa, Eucalyptus sp.
MVKAYLRYEPAAAFGVIASVESNIAYDASGKHLLAPALEKVGVWHVRQGVCTKALAPSASSAAGPSLAVTAIASSPSSLIASGYADGSIRIWDFEKGSCETTLNGHKGAVSVLRYGKLGSLLASGSKDNDIILWDVVGETGLYRLRGHRDQVTDLVFLDSDKKLVSSSKDKYLRVWDLETQHCMQIVGGHHSEIWSLDTDPEERYLVTGSADPELRFYTVKNDSSDERSEADASGGVGNGDLASHNKWDVLKQFGEIQRQSKDRVATVRFNKNGNLLACQAAGKLVEVFRVLDEAEAKRKAKRRLHRKREKKGADVNENGDSSRGIGEGHDTMVTVADVFKLLQTIRASKKICSISFCPVAPKSSLATLALSLNNNLLEFHSIEADKTSKMLTIELQGHRSDVRSVTLSSDNTLLMSTSHNSVKIWNPSTGSCLRTIDSGYGLCGLIVPQNKHALIGTKDGAIEIFDVGSGTCIEVVEAHGGSIRSIVAIPNQNGFVTGSADHDIKFWEYGMKQKPGDNSKHLTVSNVRTLKMNDDVLVVAVSPDAQKIAVALLDCTVKVFFMDSLKLMHSLYGHRLPVLCLDISSDGDLIVTGSADKNLMIWGLDFGDRHKSIFAHGDSIMAVQFVGNTHYMFSVGKDRLVKYWDADKFELLLTLEGHHADIWCLAISNRGDFLVTGSHDRSIRRWDRTEEPFFIEEEKEKRLEEMFESDLDNAFGNKYVPKEEIPEEGAVALAGKKTQETLSATDSIIEALDIAEVELKRIAEHEEEKNNGKTAEFHPNYVMLGLSPSDFILRALSNVQTNDLEQTLLALPFSDALKLLSYLKDWTTYPDKVELVSRIATVLLQTHYNQLVSTPAARPLLTTLKDILHKKVKECKDTIGFNLAAMDHLKQLMALRSDALFQDAKVKLLEIRSQLSKRLEERTDPREAKRRKKKQKKSTNMHAWP

SEQ ID NO: 376 - protein, 334 aa, Eucalyptus sp.
MGGVQAEREDKDKVSLELTEEILQSMEVGMTFRDYSGRISSMDFHRASSYLVTASDDESIRLYDVASATCLKTINSKKYGVDLVSFTSHPMTVIYSSKNGWDESLRLLSLHDNKYLRYFKGHHDRVVSLSLCPRNECFISGSLDRTVLLWDQRAEKCQGLLRVQGRPATAYDDPGLVFAIAFGGCVRMFDARKYEKGPFEIFSVGGDVSDANVVKFSNDGRLMLLTTTDGHIHVLDSFRGTLLYTFNVKPTSSKSTLEASFSPEGMFVISGSGDGSVYAWSVRGGKEVASWLSTDTEPPVIKWAPGNLMFATGSSELSFWIPDLSKLGAYVGRK

SEQ ID NO: 377 - protein, 349 aa, Eucalyptus sp.
MAAFGAAPAGNHNPNKSSEVIQPPSDSVSSLCFSPRANHLVATSWDNQVRCWELTKNGASVTSVPKASMSHDQPVLCSAWKDDGTTVFSGGCDKQAKMWSLMSGGQPVTVAMHDAPIKEIAWIPEMNVLVTGSWDKTLKYWDTRQSNPVHTQQLPERCYAMTVRYPLMVVGTADRNLIVFNLQNPQAEFKRFSSPLKYQTRCVAAFPDQQGFLVGSIEGRVGVHHLDDSQISKNFTFKCHRDNNDIYSVNSLNFHPVHHTFATAGSDGTFNFWDKDSKQRLKAMSRCSQPIPCSTFNNDGTIYAYSVCYDWSKGAENHNPATAKTYIFLHLPQESEVKAKPRVGTTNRK

SEQ ID NO: 378 - protein, 524 aa, Eucalyptus sp.
MNCSISGEVPEEPVVSTKSGHVFERRLIERYVSDYGKCPVSGEPLTMDDVLPVKMGKIVKPRPLQAASIPGLLSIFQNEWDSLMLSNFALEQQLHTARQELSHALYQHDAACRVIARLKKERDEARSLLALAERQIPMTASSDIAVNAPAMSNGRKASLDEEPGYAGKKMRPGISASIIAEITDCNLALSQQRKKRQIPSTLAPVEDLERYTQLSSYPLHKTGKPGITSLDICHSKDIIATGGIDTSAVLFDRSSGQIMSTLSGHSKKVTSVNFDAQGDMVLTGSADKTVRIWQGSEDGSYNCRHILKDHTAEVQAITVHATNNYFATASLDNTWCFYEFSTGLCLTQVEGASGSEGYTSAAFHPDGLILGTGTSNADVKIWDVKTQANVTTFSGHTGAITAISFSENGYFLATAAQDGVKLWDLRKLKNFRTFSAYDKDTGTNSVEFDHSGCYLGLAGSDIRVYQVASVKSEWNCVKTFPDLSGTGKVTCVKFGPDSKYIAVGSMDHNLRIFGLPSEDGAMES

SEQ ID NO: 379 - protein, 350 aa, Eucalyptus sp.
MAAPGVETLKKEIKELKEKIAQHRLDTDGEQPLPAAAKSKSVPEVSAALKQRRILKGHFGKIYALHWSADSRHLVSASQDGKLIIWNGFTTNKVHAIPLRSSWVMTCAYSPSGNLVACGGLDNLCSVYKVPHGGNKESSSAQKTYGELAQHEGYLSCCRFIKDNEIVTSSGDSTCILWDVETKTPKAIFNDHTGDVMSLAVFDDKGVFVSGSCDATAKLWDHRVHKQCVMTFQGHESDINSVQFFPDGDAFGTGSDDSSCRLFDIRAYQQINKYSSDKILCGITSVAFSKTGKSLFAGYDDYNTYVWDTLSGNQVEVLTGHENRVSCLGVSEDGKALATGSWDTLLKIWA

SEQ ID NO: 380 - protein, 584 aa, Eucalyptus sp.
MGGVEDESEPASKRMKLSSRVLRGLANGSSRTEPAAGSSLDLMARPLPIEGDEEVIGSKGVIKRVEFVRLIAKALYSLGYEKSGARLEEESGIPLQSSVVNLFMQQISDGLWDESVVTLHKIGLSDENLVKSASFLILEQKFLELLDQEKAMDALKTLRTEITPLCIKNSRVRELSSCIISPSSCGLLNQNKRNSTRARSRSELLEELQKLLPPAVIIPERRLEHLVEQALVLQTDACMLHNSIDMEMSLYTDHQCGKEHIPCRTLQILQSHNDEVWLVQFSHNGKYLASASNDRSAIIWEVDENGSVSLKHKLTGHQKPISSVCWSPDDRQLLTCGVGETVRRWDVSSGECLRVYEKAGHGLISCAWFPDGKWICYGVSDRSICMCDLEGKEIECWKGQRTLSISDLEITSDGKQIISICRETAILLLDREAKYERMIEENQTITSFSLSKDNRYLLVNLLNQEIHLWDIKGDFRLVAKYKGLKRSRFVIRSCFGGLKQAFVASGSEDSQVYIWHKGSGELIEPLPGHSGAVNCVSWNPANHHMLASASDDRTIRIWGLNELNTRHKGARPNGVHYCNGNGTS

SEQ ID NO: 381 - protein, 607 aa, Eucalyptus sp.
MTQLAETYACMPSTERGRGILIAGNPKPGSNSVLYTNGRSVVILNLDNPLDISVYAEHAYPATVARFSPNGEWVASADSSGAVRIWGAYNDHVLKKEFKVLSGRIDDLQWSPDGLRIVASGDGKGKSLVRAFMWDSGTNVGEFDGHSRRVLSCAFKPTRPFRIVTCGEDFLVNFYEGPPFKFKLSRRDHSNFVNCLRFSPDGNRFISVSSDKKGIIYDGKTGEKIGELSSDGGHTGSIYAVSWSPDSKQVITVSADKSAKIWDISEDGSGNLRKTLTSSGSGGVDDMLVGCLWQNNHLVTVSLGGTISIYTAGDLDKAPVSFSGHMKNVSSLSVLKGDPKVILSSSYDGLIIKWIQGIGFSGRVQRKESTQIKCLAAVDEEIVTSGYDNKVCRVSGSGDAEFIDIGCQPKDLSLALQCPEFALVSTDTGVVLLRGAKIVSTINLGFAVTASTVAPDGTEAIIGAQDGKLRIYSISGDTLTEEAVLEKHRGAISVIHYSPDLSMFASGDLNREAVVWDRASREVRLKNILYHTARINCLAWSPDSSTVATGSLDTCVIIYEVDKPASNRLTIKGAHLGGVYGLAFTDDFSVVSSGEDACIRVWKINRQ

SEQ ID NO: 382 - protein, 452 aa, Eucalyptus sp.
MKVKVISRSTDEFTRERSQDLQRVFRNFDPNLRTQEKAVEYVRALNAAKLDKVFARPFVGAMDGHVDSVSCMAKNPNYLKGIFSGSMDGDIRLWDIASRRTVCQFPGHQGPVRGLAASTDGQILVSCGIDSTVRLWNVPVATLGESDGTHENLAKPLAVYVWKNAFWAVDHQWDGELFATAGAQVDIWNQNRSQPISSFEWGTDTVISVRFNPGEPNVLATSGSDRSITLYDLRMSSPTRKVIMRTKTNAISWNPMEPMNFTAANEDCNCYSYDARKLEEAKCVHKDHVSAVMDIDYSPTGREFVTGSYDRTVRIFQYNGGHSREVYHTKRMQRVFCVKFSCDASYVISGSDDTNLRLWKAKASEQLGVVLPRERRKHEYHEAVKSRYKHLPEVKRIVRHRHLPKPIYKAGILRRTVNEADRRKEERRKAHSAPGSSSAEPLRKRRIIKEIE

SEQ ID NO: 383 - protein, 474 aa, Eucalyptus sp.
MVRSIKNPKKAKRKNKGSKNGDGSSSSSSIPSMPTKVWQPGVDKLEEGEELQCDPSAYNSLHAFHIGWPCLSFDIVRDTLGLVRTEFPHQVYFVAGTQAEKPTWNSIGIFKVSNITGKRRELVPSKPTDDADEESDSSDSDEDSDDEVGGSGTPILQLRKVGHEGCVNRIRAMNQNPHICASWGDSGHVQIWDFSSHLNALAESEADVSQGASSVFNQAPLVKFGGHKDEGYALDWSPLVPGRLVSGDCKNSIHLWEPTSGSTWNVDSTPFIGHAASVEDLQWSPTEENVFASCSVDGTIAIWDTRLGKTPAASFKAHDADVNVISWNRLATCMLASGCDDGTFSIHDLRLLKEGDSVVAHFEYHKHPVTSIEWSPHEASTLAVSSADCQLTIWDLSLEKDEEEEAEFKAKTKEQVNAPEDLPPQLLFVHQGQKDLKELHWHAQIPGMIVSTAADGFNILMPSNIQSTLPSDGA

SEQ ID NO: 384 - protein, 460 aa, Pinus radiata
MERYKVIKELGDGTYGSVWKALNQQTHEIVAIKKMKRKYYIWEECINLREVKSLRKLNHPNIIKLKEVIRENNELFFIFEYMECNLYQIMKERSTPFSETAIIKFCYQILQGLSYMHRNGYFHRDLKPENLLVTSDLIKIADFGLAREVLTSPPYTDYVSTRWYRAPEVLLQSPTYTTAIDMWAVGAILAELFTLHPLFPGESELDEIYKICGVLGTPDYETWPDGMQLAAFRNFIFPQFLPVNLSVLIPHASPEAIDLITRLCSWDPQKRPTAEQALHHPFFRIGMSIPLSLGGHFQDNTCAAEVDTNFHSKKACKGRGMGEKESSLECFLGLSLGLKPSLGHLGAMGSQGVGAVKQEVGSSPGCQSNPKQSLFQVLNSRAILPLFSSSPNLNVVPVKSSLPSAYTVNSQVMWPTIAGPPAAAVTVSTLQPSILGDFKIFGKSMGLASQYAGKEASPFS

SEQ ID NO: 385 - protein, 476 aa, Pinus radiata
MGEMGRGINNSSNNNNSNRPAWLQHYDLVGKIGEGTYGLVFLARSKLPNNRGLRIAIKKFKQSKDGDGVSPTAIREIMLLREFSHENVVKLVNVHINHVDMSLYLAFDYAEHDLYEIIRHHREKLNHHNINQYTVKSLLWQLLNGLNYLHSNWIVHRDLKPSNILVMGEGEEHGVVKIADFGLARIYQAPLKPLSDNGVVVTIWYRAPELLLGAKHYTSAVDMWAVGCIFAELITLKPLFQGVEVKASPNPFQLDQLDKIFKVLGHPTIEKWPTLMNLPHWSKNLQQIQQHKYDNAGLHIGPIPAKSPAYDLLSKMLEYDPRKRITAAQALEHEYFRIDPQPGRNALVPSQPGEKAINYPPRLVDANTDFDGTIAPQPSQVSSGNAPSGSIASAAVPAVRPLPQQMQLMGMQRMQNPGMAAFNLGAQASMSGLNHNNIALQRGSSQQQAHQQVRRKEPNSGFPNTGYPPPPKSRRL

SEQ ID NO: 386 - protein, 302 aa, Pinus radiata
MDKYEKLEKVGEGTYGKVYKARDKMTGQLVALKKTRLEMDEEGVPPSSLREISLLQMLSQSIYVVRLLCVEHVTKKGKPLLYLVFEYLDTDLKKFIDYRRSVNAGPLPQNVIQSFMYQLLKGVAHCHSHGVLHRDLKPQNLLVDKSKGLLKVGDLGLGRAFTVPLKCYTHEVVTLWYRAPEVLLGSTHYSTPVDIWSVGCIFAEMVRRQPLFPGDCEIQQLLHIFTLLGTPTEEMWPGVKRLRDWHEYPQWKPENLARAVPNLSPTGLDLISKMLQCDPAKRISAKAAMNHPYFDDLDKSQF

SEQ ID NO: 387 - protein, 302 aa, Pinus radiata
MDGYEKMDKVGEGTYGKVYMARDKKTGQLVALKKTRLENDGEGIPPTALREISLLQMLSQDIYIVRLLDVKHTENKLGKPLLYLVFEYMESDLKKYIDSYRRSHTKMPPSMIKSFMYQLCRGVAYCHSRGVMHRDLKPHNLLVDKEKGVLKIADLGLSRAFTVPVKKYTHEIVTLWYRAPEVLLGATHYSLPVDIWSVGCIFAEMSRMQALFTGDSEVQQLMNIFRFLGTPNEEVWPGVTKLKDWHIYPEWKPQDISHAVPDLEPSGLDLLSQMLVYEPSKRISAKKALEHPYFDDLDKSQF

SEQ ID NO: 388 - protein, 302 aa, Pinus radiata
MDAYEKLEKVGEGTYGKVYKAKDKNTGQLVALKKTRLESDDEGIPPTALREISLLQMLSQDIHIVRLLDVEHTENKNGKPLLYLVFEYMDSDLKKYIDGYRRSHTKVPPNIIKSFMYQLCQGVAYCHSRGVMHRDLKPHNLLVDKQRGVVKIADLGLGRAFTIPIKKYTHEIVTLWYRAPEVLLGATHYSTPVDIWSVGCIFAEMVRLQALFIGDSEVQQLFKIFSFLGTPNEEIWPGVTKFRDWHIYPQWKPQDISSAVPDLEPSGVDLLSKMLVYEPSKRISAKKALEHPYFDDLDKSQF

SEQ ID NO: 389 - protein, 302 aa, Pinus radiata
MDSYEKLEKVGEGTYGKVYKAKDKKTGKLVALKKTRLENDGEGIPPTALREISLLQMLSQDMNIVRLLDVEHTENKNGKPLLYLVFEYMDSDLKKYVDGYRRSHTKMPPKIIKSFMYQLCQGVAYCHSRGVMHRDLKPHNLLVDKQRGVLKIADLGLGRAFTVPIKKYTHEIVTLWYRAPEVLLGATHYSTPVDIWSVGCIFAEMSRMHALFCGDSEVQQLMSIFKFLGTPNEGVWPGVTKLKDWHIYPEWRPQDLSRAVPDLEPSGVDLLTKMLVYEPSKRISAKKALQHPYFDDLDKSQF

SEQ ID NO: 390 - protein, 301 aa, Pinus radiata
MEKYEKLEKVGEGTYGKVYKGRDKRTGRLVALKKTPFHQEEGIPPTAIREISLLKSLSQCIYIVKLLDVKASFNGKGKHVLFMVFEYADSDLKKHIDAHRQCNTKLSPRSIQSYMFQLCKGIAYCHSHGVLHRDLKPQNILVDQKIGLLKIADLGLGRACTVPIKSYTFEVVTLWYRAPEVLLGAKRYSMALDIWSLGCIFAELCNLQALFAGDSQIQQLINIFRLLGTPNEQLWPGVTQLSDWHEFPQWRPQDLSKVVFNLDPNGVDLLSKMLQYDPAKRISAKEALDHPYFDSLDKSQF

SEQ ID NO: 391 - protein, 845 aa, Pinus radiata
MGCVCGKPSARAADYVESPAEKGASSNSRSSSMASRRLVAPAVMDQGIDAENGHEGDYRTKLRGKQSNGADPVSLLSDDAEKQRHSRHHQHQQHHPIRPHHLRPQGEFVPNANSNPRFGNPPRHIEGEQVAAGWPAWLTAVAGEAIKGWIPRRADSFEKLDKIGQGTYSNVYKARDLDTGKIVALKKVRFDNLEPESVRFMAREIQVLRRLDHPNVVKLEGLVTSRMSCSLYLVFEYMDHDLAGLAACPGIKFTEPQVKCYMQQLLRGLDHCHSRGVLHRDIKGSNLLIDNGGILKIADFGLATFFHPDQRQPLTSRVVTLWYRPPELLLGATEYGVAVDLWSTGCILAELLAGKPIMPGRTEVEQLHKIFKLCGSPSEDYWKKSKLPHATIFKPQQPYKRCVAETFKDFPPSALALMEVLLAIEPADRGTATSALKSDFFTTKPLACDPSSLPKYPPSKEFDAKIRDEEARRQRAAGGRGRDAARRPSRESRAIPAPEANAELAISIQKRRLSSQGPSKSKSEKFNPQQEDGAVGFPIEPPRPMHIGIDAGATSRMYSQQFGPSHSGPLSNQISSSIWGKNQKEDEIQMAPGRPSRSSKATISDFRKPGACAPQPGADLSHLSSLVATARSNAGIDTHKDRSGMWQHNRIDAIDGVHNNGKHEFLEVPEHPNRQDWTRFQQPESFKGLDNYHLQDLPATHHRKDERVASKEATMNWQGYGGQGGDKIHYSGPLLPPSGNIDEILKEHERHIQHAVRRARQDKGRPQRSNLSQNERKAFEHRSFVSGVNGNAGYSDLVNELPISVGSNRLKVSKTRGTEEIVELRELEREPLSSVMEKYEREHEM

SEQ ID NO: 392 - protein, 797 aa, Pinus radiata
MGCVCAKQSDILGEPESPKVKGSNLASSRWSVSSETKQLPQHSDSGILHHQHYYHPRDESDEAKLKESNYGGSKRRTRQGRDPADLDMGIFVRTPSSQSEAELVAAGWPAWMAAFAGEAIHGWIPRRAESFEKLYKIGQGTYSNVYKARDLDNGKIVALKKVRFDSLDAESVRFMAREILVLRKLDHPNIVKLEGLVTSEVSSSLYLVFEYMEHDLAGLAACPGIKFTEPQVKCYMQQLLQGLDHCHRHGVLHRDIKGSNLLIDNGGILKIADFGLATFFYPDQKQLLTSRVVTLWYRPPELLLGATDYGVAVDIWSAGCILAELLAGKPILPGRTEVEQLHKIFKLCGSPSEDYWKESKLPHATIFKPQHPYKSCIAEAFKDFSPSALALLETLLAIEPGHRGEASGALKSEFFTTEPLSCDPSSLPKYPPSKEFDAKLRAQETRRQRDVGVRGHGSEAARRTSRLSRAGPTPNEGAELTALTQKQHSTSHATSNIGSEKPSTKKEDYTAGLHIDPPRPVNHSYETTGVSRAYDAIRGVAYSGPLSQTHVSGSTSGKKPKRDHVKGLSGQSSLQPSKPFIVSDSRSERIYEKSHVTDLSNHSRLAVGRNRDTTDPHKSLSTLMQQIQDGTLDGIDIGTHEYARAPVSSTKQKSAQLQRPSALKYVDNVQLQNTRVGSRQSDERPANKESDMVSHRQGQRIHCSGPLLHPSANIEDLLQKHEQQIQQAVRRAHHGKREALSNKSSLPGKKPVDHRAWVSSGKGNKESPYFKGKGNKELSDLKGGPTAKVTNFRQKVM

SEQ ID NO: 393 - protein, 509 aa, Pinus radiata
MAVANPGQLNLQEAPSWGSRSVNCFEKLEQIGEGTYGQVYMAKEIETGEIVALKKIRMDNEREGFPITAIREIKLLKKLQHENVIKLKEIVTSPGPEKDEQGKSDGNKYNGSIYMVFEYMDHDLTGLAERPGMRFSVPQIKCYMKQLLIGLHYCHINQVLHRDIKGSNLLIDNNGILKLADFGLARSFCSDQNGNLTNRVITLWYRPPELLLGSTKYGPAVDMWSVGCIFAELLYGKPILPGKNEPEQLTKIFELCGSPDESNWPGVSKLPWYSNFKPQRQMKRRVRESFKNFDRHALDLVEKMLTLDPSQRISAKDALDAEYFWTDPVPCAPSSLPRYEPSHDFQTKRKRQQQRQHDEMTKRQKISQHPPQQHVRLPPIQNAGQGHLPLRPGPNPTMHNPPPQFPVGPSHYTGGPRGAGGQNRHPQNIRPLHAAQGGGYNANRGYGGPPQQQGGGYPPHGMGNQGPRGGQFGGRGAGYSQGGPYGGPVGGRGPNVGGGNRGPQFWSEQ

SEQ ID NO: 394 - protein, 436 aa, Pinus radiata
MQNMEDNVQSSWSLHGNKEICARYEILERVGSGTYSDVYRGRRKADGLIVALKEVHDYQSSWREIEALQRLCGCPNVVRLYEWFWRENEDAVLVLEFLPSDLYSVIKSGKNKGENGIPEAEVKAWMIQILQGLADCHANWVIHRDLKPSNLLISADGILKLADFGQARILEEPEAIYEVEYELPQEDIVADAPGERLMEEDDSVKGVRNEGEEDSSTAVETNFGDMAETANLDLSWKNEGDMVMQGFTSGVGTRWYRAPELLYGATIYGKEIDLWSLGCILGELLILEPLFSGTSDIDQLSRLVKVLGTPTEENWPGCSNLPDYRKLCFPGDGSPVGLKNHVPSCSDSVFSILERLVCYDPAARLNAKEVLENKYFVEDPYPVLTHELRVPSPLREENNFSEDWAKWKDMEADSDLENIDEFNVVHSSDGFCIKFS

SEQ ID NO: 395 - protein, 463 aa, Pinus radiata
MDLNQYPEDLNPELPEGTDNVDNPDNNKGSPVPSPHPPLKPLDPSERYRKGITLGQGTYGIVYKAFDTVTNKTVAVKKIHLGKAKEGVNVTALREIKLLKELSHPNIIQLIDAYPHKQNLHIVFEFMETDLEAVIKDRNLVFSPADIKSYLQMTLKGLAVCHKKWVLHRDMKPNNLLIAADGQLKLGDFGLARLFGSPDRKFTHQVFAVWYRAPELLFGAKQYGPAVDIWATGCIFAELLLRKPFLQGVSDLDQIGKIFAAFGTPRQSQWPDVASLPDFVEFQFVPAPSLRSLFPMASEDALDLLSKMFTLDPKNRITAQQALEHRYFSSVPAPTRPDLLPKPSKVDSSRPPKHASPDGPVVLSPSKARRVMLFPNNLAGILPKQVSQSTTGGTPIEFDMPTQKLREVCPRSRITESGKKHLKRKTMDMSAALDECAREQEGQEGKTILDPDHQRSAKKEKHM

SEQ ID NO: 396 - protein, 450 aa, Pinus radiata
MAGGQENCVRITRARAACVSKASAPVIQSQVDEKKSRKRAPKRAAVDDLAANASGSQPKRRAVLGDVTNLHAAATDCLSTAEDQVDAPNPSIKGRARNKKKEARTSTKVVKDEIHPESNPLADHSSNLSECQKPPAAKLAEQRSLRGVPSKAKQGGSSNSQSCSKHTDIDKDHTDPQMCTTYVEDIYEYLRNAELKNRPSANFMETAQNDITPNMRAILVDWLVEVSEEYKLVPDTLYLTVSYIDRYLSANPTSRHKLQLLGVSCMLIASKYEEVCPPHVEEFCYITDNTYTRDEMLSMERKILIFLNFEMTKPTTKSFLRRFVRASQAGNKAPSLHMEFLANYLAELTLMECSFLQYLPSLIAASTVFLSRLTLDFLTNPWNPTLAHYTGYKASQLKDCVMAIYNVQMNRKGSTLVAIREKYQQHKFKCVASLPPPPFIAERFFEDTPN

SEQ ID NO: 397 - protein, 518 aa, Pinus radiata
MTGTQASNVRITRARAAKSTLNNALPPLPPAQGKPRGKRAATESNISGFSVAAEPLKRRAVLSDVSNICKEAAAVDCLKKPKAVKVVSQNANAKGRGRGIPRNNKKITQEAEIKKETSPAICNVDDASAGNAIGDDKQNNNVNPLKEVQDNPKELNPIAEQISVHPHCKQSVEKPNEKEIVVSDNKAAIASLKQQSTLQSLRIPKQPKYSLKQGNPVPLANLHEDVGRSSCSDFIDIDSEYKDPQMCTAYVTDIYANMRVVELKRRPLPNFMETTQRDINANMRSVLIDWLVEVSEEYKLVPDTLYLTVSYIDRFLSANVVNRQRLQLLGVSCMLVASKYEEICAPPVEEFCYITDNTYKKEEVLEMEISVLNRLQYDLTTPTTKTFLRRFIRAAQASCKVSSLHLEFMGNYLAELTLVEYDFLKYLPSLIAAAAVFVARMTLDPMVHPWNSTLQHYTGYKVSDMRDCICAIHDLQLNRKGCTLAAIREKYNQPKFKCVANLFPPPIISPQFLIDNEV

SEQ ID NO: 398 - protein, 469 aa, Pinus radiata
MAAPNQNALLINNNNRRPLVDIGNLVGALNAQCNISKNGARKRAFGDIGNLVEDLDAKCTISKYWVRKRPRTNFGVNANKGASSSTQGQGIVVRGEQKAWDRIVWGNKQSCAIKMNAQHVTATQRGTAISISDIIDSSVQDGGIKAPSQLKARKQTVRTVTATLTARSEDSLRDVLEVPPGIDDGDRDNPLAVVEYVEDIYHFYRKIEVRSCVPPDYMTRQLEIKDSMRGVIIDWLIEVHRTFLLMPETLYLTVNIIDRYLSIQSVTRNELQLMGITAMFIASKYEEISPPKINDLVYITKDAYTSKQIVNMEHTILNRLKFKLTVPTPYVFLVRFLKAAGPDKVMKNLAFFLVDLCLLHYKMIKYSPSMLAAAAVYTAQCTLKKHPYWNKTLILHIGYSEAHLRECAHLMADLHLKAEGSNLKSVYKKYSYPIFGSVAFLSPAKIPAGTVAAPAIDKCAHQIYLRNLR

SEQ ID NO: 399 - protein, 471 aa, Pinus radiata
MFPNKQTQGLVQNKKMASKAAQPKAMVPPQRVPPAANNRRALGDIGNIVADVGGKCNVTKDGVNGKPLAQVSRPITRSFGAQLLAQAAANKGISAANNQTQVPVVIPKADVRGNKQRRTSKSKDIPPTTVVTNESDDCVIIEQAQRIKPTCNHNVGAVGNKEKPQLLTAKPKSLTASLTSRSAVALRGFRFDDEMTEAEEDPLPNIDVGDRDNQLAVVEYVEDIYKFYRRTEQMSCVPDYMPRQQEINPKMRAVLINWLIEVHYRFGLMPETLYLTTNLIDRYLATQLVSRSNYQLVGATAMLLASKYEEIWAPEMNDFLDILENKFERKHVLVMEKAMLNKLKFHLTVPTPYVFLVRFLKAAASDEEMENLVFFLMELSLMQYVMIKFPPSMLAAAAVYTAQITLKKTTVWNDVLKRHTGYSEIDLKECTRLMVAFHQSSEESKLNVVFKKYSMPEYDSVALIKPAKLPA

SEQ ID NO: 400 - protein, 342 aa, Pinus radiata
MAPSFDCVANAYIESCEDQEKLRQNAQILAQSGENDVDEPVSMLVQRETHYMLPEDYLQRLRNRTLDVNVRREAVGWILKVHSFYNFGAPTAYLAVNYLDRFLSRHRMPQGVKAWMIQLMAVACLSLAAKMEETQVPLPSDLQREDARFIFDARTIQRMELLILSTLQWGMRSITPFSFIDYFAYRAVQGHGHGHDATPKAVMSRAIELILSTTEEIDFMEYRPSAIAAAALLCAAEEVVPLQAVHYKRALSSSITDVDKDKMFGCYNLIQETIIEGGCYWTPMSLQSTEKTPVGVLDAAACLSNTPTSSYSVKPYASVTAAKRRKLNEICSALLVSQAHPC

SEQ ID NO: 401 - protein, 248 aa, Pinus radiata
MAANFWTSSHCKELLDAEKVGIVHPLDKDQGLTQEDVKIIKINMSNCIRTLAQYVKLRQRVVATAITYCRRVYTRKSFTEYDPQLVAPTCLYLASKAEESTVQAKLVIFYMKKYSKHRYEIKDMLEMEMKLLEALDYYLVIYHPYRPLIQFLQDAGLNDLKVTAWALVNDTYRTDLILTYPPYMIALACIYFACIMEEKDAQAWFEELRVDMNEIKNISMEIVDYYDNYRVIPDEKMNSALNKLPHRF

SEQ ID NO: 402 - protein, 358 aa, Pinus radiata
MAPALSSSYECLSHLLCAEDASNVVGCWDEDESKIFCEEEEGFGIQHFPDFPVPDDDEIRVLVRKESQYMPGKSYVQSYQNLGLDFTARQNAIGWILKVHGSYNFGPLTAYLSINYLDRFLSRNPLPKAKVWMLQLLSVACLSLAAKMEETQVPLLLDLQAEEPDFLFEPRTIQRMELLVLSTLEWRMLSVTPFSFVDYFLQGGGGRKPPPRAMVARANELIFNTHTVLDFLEHRPSAIAAAAVICAAEEVLPLEAAQYKETILSCSLVDKEWVFGSYNLIQEVLIEKFSTPKKAKSASSSIPQSPVGVLDAFCLSNNSNNTSLEASLSVNLYASVAAKRRKLNDYCNTWRMFQHSTC

SEQ ID NO: 403 - protein, 365 aa, Pinus radiata
MAPNCIDCAPSDLFCAEDAFGVVEWGDAETGSLYGDEDQLHYNLDICDQHDEHLWDDGELVAFAEKETLYVPNPVEKNSAEAKARQDAVDWILKVHAHYGFGPVTAVLSINYLDRFLSANQLQQDKPWMTQLAAVACLSLAAKMDETEVPLLLDFQVEEAKYIFESRTIQRMELLVLSTLEWRMSPVTPLSYIDHASRMIGLENHHCWIFTMRCKEILLNTLRDAKFLGLLPSVVAAAIMLHVIKETELVNPCEYENRLLSAMKVNKDMCERCIGLLIAPESSSLGSFSLGLKRKSSTINIPVPGSPDGVLDATFSCSSSSCGSGQSTPGSYDSNNSSILCISPAVIKKRKLNYEFCSDLHCLED

SEQ ID NO: 404 - protein, 93 aa, Pinus radiata
MPQIQYSEKYTDDTYEYRHVVLPPETAKLLPKNRLLNENEWRAIGVQQSRGWVHYAIHRPEPHIMLFRRPLNYQQNQQQQAGAQSQPMGLKAQ

SEQ ID NO: 405 - protein, 105 aa, Pinus radiata
MDQIEYSEKYYDDTYEYRHVELPPDVARLLPKNRLLTENEWRGIGVQQSRGWVHYAIHCSEPHIMLFRRPLNYEQNHQHPEPHIMLFRRPLNCQPNHQPQAHHPT

SEQ ID NO: 406 - protein, 105 aa, Pinus radiata; identical to SEQ ID NO: 405

SEQ ID NO: 407 - protein, 93 aa, Pinus radiata
MPQIQYSEKYYDDTYEYRHVVLPPDVARLLPKNRLLNENEWRGIGVQQSRGWVHYAIHRPEPHIMLFRRHLNYQQNQQQQAQQQPAQAMGLQA

SEQ ID NO: 408 - protein, 574 aa, Pinus radiata
MALVETEPVTLIHPEEPKKFKKKPTPGRGGVISHGLTEEEARVKAIAEIVGAMVEGCRKGEDVDLNALKAAACRRYGLSRAPKLVEMIAALPDGERAAVLPKLKAKPVRTASGIAVVAVMSKPHRCPHIATTGNICVYCPGGPDSDFEYSTQSYTGYEPTSMRAIRARYNPYVQTRSRIDQLKRLGHTVDKVEFILMGGTFMSLPADYRDYFIRNLHDALSGHTSSNVEEAVCYSEHSATKCIGLTIETRPDYCLGPHLRQMLSYGCTRLEIGVQSTYEDVARDTNRGHTVAAVADCFCLAKDAGFKVVAHMMPDLPNVGVERDMESFREFFENPAFRADGLKIYPTLVIRGTGLYELWKTGRYRNYPPEQLVDIIARVLALVPPWTRVYRVQRDIPMPLVTSGVEKGNLRELALARMDDLGLKCRDVRTREAGIQDIHHKIRPEVVELVRRDYCANEGWETFLSYEDTRQDILVGLLRLRKCGHNTTCPELKGRCSIVRELHVYGTAVPVHGRDADKLQHQGYGTLLMEQAERIAWKEHRSIKIAVISGVGTRHYYRKLGYELEGPYMMKYLN

SEQ ID NO: 409 - protein, 510 aa, Pinus radiata
MLGFRDLYTSICEHLQRASGRLPIIAAATSLISTPEIAAVEKENKAPNSVDKMGMGSADESGRFSTSNGQFMNMNNGVVKEEWKGGVPVVPSAPTTVPVITNVKLETPSSPDHDMARKRKLGFLPLEVGTRVLCKWRDGKFHPVKIIERRKLPNGATNDYEYYVHYTEFNRRLDEWVKLEQLELDSVETDADEKVDDKAGSLKMTRHQKRKIDETHVEGNEELDAASLREHEEFTKVKNITKIELGRYEIETWYFSPFPSEYNNCEKLYFCEFCLNFMKRKEQLQRHMRKCDLKHPPGDEIYRSGTLSMFEVDGKKNKVYAQNLCYLAKLFLDHKTLYYDVDLFLFYILCECDERGCHMVGYFSKEKHSEESYNLACILTLPPYQRKGYGKFLISFSYELSKKEGKVGTPERPLSDLGLLSYRGYWTRVLLDILKKHKSNISIKELSDMTAIKADDVLSTLQGLDLIQYRKGQHAICADPKVLDRHLKAVGRGGLEVDVCKLIWTPYKEQ

SEQ ID NO: 410 - protein, 441 aa, Pinus radiata
MGSLDESTCSEEIRDEGKDSIRTKFKVESTVNNAQNGGNDNSKKKRAAGLPLEVGIRLLCKWRDSKLHPVKIIERRKLPNGFPQDYEYYVHYTEFNRRLDEWVKLEQFELDSVETDADEKIEDKGGSLKMTRHQKRKIDEIHVEEGQGHEDFDPASLREHEEFTKVKNIAKVELGRYEIETWYFSPFPPEYSHCEKLFFCEFCLNFMKRKEQLQRHMRKCDLKHPPGDEIYRNGTLSMFEVDGKKNKIYGQNLCYLAKLFLDHKTLYYDVDLFLFYVLCECDDRGCHVVGYFSKEKHSDEAYNLACILTLPPYQRKGYGKFLIAFSYELSKKEGKVGTPERPLSDLGLLSYRGYWTRILLDILKKQRGNISIKELSDMTAIKVEDVISTLQVLDLIQYRKGQHVICADPKVLDRHLKAAGIAGLEVDVSKLIWTPYKEQCG

SEQ ID NO: 411 - protein, 644 aa, Pinus radiata
MASAPMVGCDDSRDKHRWVESKVYMRKGHGKGSKGNAGFNAQNSTAQVRRENDNMNSIADNGKSEAASEGLSSLSRKQITVNQDHPPNETSSMPAVGGLQNIDTHVTFKLEGCSKQEIWELRKKLTNELEQVRGTFKKLEARELQLRGYSVSAGVNTSYSASQFSGNDMRNNGGKEVTSEVASGGAITPKQAQRESNPPRQLSISLMENNQAASDMGEKGKRTPKANQYYRNSEFVLGKDKFPPAESKKSKSTGNKKISQSKVFSKETMQVGKEFMPQKSVNEVFKQCSLLLTKLMKHKYGWVFNLPVDAQALGLHDYHTIIKRPMDLGTVKSKLEKNLYNSPASFAEDVKLTFSNAMTYNPKGHEVHTMAEQLLQLFEERWKTIYEEHLDGKMRFGSGQGLGASSSTKKLPFQDSKKNIKKSEPAGGPSPPKPKSTNHHASRTPSAKKPKAKDPHKRDMTYEEKQKLSTNLQNLPQERLELIVQIIKKRNPSLCQHDEEIEVDIDSFDTETLWELDRFVTNYKKSLSKNKKKALLADQAKRASEHGSARNKHPMIGRELPMNNKKGEQGEKVVEIDHMPPVNPPVVEVEKDGVYAKRSSSSSSSSSDSGSSSSDSDSGSSSGSESDAYAATSPPAGSNTSARG

SEQ ID NO: 412 - protein, 587 aa, Pinus radiata
MEGHSGALGFGQGFSRSSQSPNLSPSPSHSASASVTSSGQKRKRNEVEHAGVASNSTGMFAVPPSHIYSHLHPMSMSMPMPMHNSHPSSLSESRDGALTSNDDDDNLTGGNQSQLDSMSAGNTDGREDFDDEDDDDDDEEDDDEVEGDEEDQDHDPDADDDSDDGHDSMRTFTAARLDNGAPNSRNLKPKADAAGVAIAPTVKTEPILDTVKEEKVSGNNNNNSVSANNAQVAPSGSAVLLSAVKEEANKPTSTDHIQTSGAYCAREESLKREEDADRLKFVCFGNDGIDQHMIWLIGLKNIFARQLPNMPKEYIVRLVMDRSHKSVMIIKQNQVVGGITYRPYLSQKFGEIAFCAITADEQVKGYGTRLMNHLKQHARDVDGLTHFLTYADNNAVGYFIKQDFTKEIKLEKERWHGYIKDYDGGILMECKIDPKLPYTDLPAMIRWQRQTIDEKIRELSNCHIVYSGIDIQKKEAGIPRKPIKVEDIPGLKEAGWTTDQWGHSRFRLLNSPSEGLPNRQVLHAFMRSLHKAMVEHADAWPFKEPVDPRDVPDYYDIIKDPMDVKRMFTNARTYNTHETIYYKCANR

SEQ ID NO: 413 - protein, 483 aa, Pinus radiata
MEESGNSLTSGPDGSKRRVSYFYDSDIGNYYYSQGHPMKPHRIRMAHSLIVHYALDEKMEVCRPNLLQSRELRVFHADDYISFLQSVTPETQHEQLRQLKRFNVGEDCPVFDGLYNFCQTYAGGSVGAAIKLNNKEADIAINWSGGLHHAKKCEASGFCYVNDIVLAILELLKVHQRVLYIDIDIHHGDGVEEAFYSTDRVMSVSFHKFGDYFPGTGHLKDVGYGKGKYYSLNVPLNDGIDDESYKNLFRPIIQKVMEIYQPEAVVLQCGADSLSGDRLGCFNLSVKGHADCVRFLRSFNVPLVLVGGGGYTIRNVARCWCYETAVAVGVEPQDKLPYNEYYEYFGPDYTLHVAPSNMENQNSAKELAKIRNTLLEQLKRIQHVPSVPFQERPPDTKFPEEDEEDYEKRPKGHKWGGEYFGSESDEEQKPQNRDIDISDKPGIRRQSPPNVEAAKKIKVEEEDGDIGIVNENDGAKWPLGEAG

SEQ ID NO: 414 - protein, 483 aa, Pinus radiata; identical to SEQ ID NO: 413

SEQ ID NO: 415 - protein, 345 aa, Pinus radiata
MEFWGVEVKPGEALTCDPGDERYLHMSQAAIGDKEGAKENERVSLYVHVDGKKFVLGTLSRGKCDQIGLDLVFEKEFKLSHTSQTGSVFVSGYTTVDHEALDGFPDDEDLESSEDEEEELAQITTLTAKENGGKTGAKPVKPESKSSVTDKAAAKGKPEVKPPVKKQEDDSDSDEDEDEDEDEDEDDDDEDDEDMKDASASDDGDEEDDSDEESDDDEEEDEETPKPAAGKKRPMPASDNKSPATDKKAKITTPAGGQKPGADKGKKTEHIATPYPKHGAKGPASGVKGKETPLGSKQTPGSKVKNSSTPESGKKSGQFKCQSCSRDFATEGALSSHNAAKHGGK

SEQ ID NO: 416 - protein, 628 aa, Pinus radiata
MMETGGNSLPSGPDGVKRKVAYFYDPEVGNYYYGQGHPMKPHRIRMTHALLVQYGLHKEMQILKPYPARDRDLCRFHADDYVAFLRGITPETIQDQVKALKRFNVGDDCPVFDGLYQYCQTYAGGSVGGAVKLNHKLCDIAINWAGGLHHAKKCEASGFCYVNDIVLAILELLKYHKRVLYVDIDIHHGDGVEEAFYTTDRVMTVSFHKFGDYFPGTGDIRDIGCGKGKYYAVNVPLDDGIDDESFQSLFKPIIQQVMLVYNPEAIVLQCGADSLSGDRLGCFNLSVKGHAECVRYMRSFNVPLLMVGGGGYTVRNVARCWCYETGVAVGVEIDDKMPQHEYYEYFGPDYTVHVAPSNMENKNTKQYLDKIRSKILENINSLPCAPSAQFQVQPPDTDFPELEEEDYDERTRSHKWDGASCDSDSENGDLKHRNHDVEESAFPRHNLANISYNTKIKLEGVGTGGLDMAAGTDTKKNDESFEAMDYESGEELRQDHFASTINASQPCDPALLTGVQNQLQSTDTVKPIEQSGNAPGIPPPSVATVSTGTRPSSISRTSSLNSMSSVKQGSILGPNPPQGLNASGLQFPVPTSNSPIRQGGSYSITVQAPDKQGLQNHMKGPQNMPGNS

SEQ ID NO: 417 - protein, 432 aa, Pinus radiata
MPPKDRVAYFYDGDVGSVYFGPNHPMKPHRLCMTHHLVLSYELHKKMEIYRPHKAYPVELAQFHSADYVEFLHRITPDTQHLFTKELVKYNMGEDCPVFENLFEFCQIYAGGTIDAAHRLNNQICDIAINWSGGLHHAKKCEASGFCYINDLVLGILELLKHHARVLYVDIDVHHGDGVEEAFYFTDRVMTVSFHKYGDMFFPGTGDVKEVGEREGKYYAINVPLKDGIDDASFTRLFKTIITKVVDIYQPGAIVLQCGADSLAGDRLGCFNLSIDGHAQCVRIVKKFNLPLLVTGGGGYTKENVARCWSVETGVLLDTELPNEIPDNDYIKYFAPDYSLKINTAGNMENLNSKTYLSAIKVQVMENLRAIQHAPSVQMHEVPPDFYIPDIDEDELNPDERMDQHTQDRQIQRDDEYYDGDNDIDHDMEEAS

SEQ ID NO: 418 - protein, 381 aa, Pinus radiata
MDSSKSEEANILHVFWHEGMLNHDLGTGVFDTLEDPGFLEVLEKHPENADRVRNMLSILRKGPIAPYTEWHTGRAAYLSELYSFHRPDYVDMLAKTSTAGGKTLCHGTRLNPGSWEAALLAAGTTLEAMRYILDGHGKLSYALVRPPGHHAQPTQADGYCFLNNAGLAVELAVASGCKRVAVVDIDVHYGNGTAEGFYERDDVLTISLHMNHGSWGPSHPQTGFHDEVGRGKGLGFNLNVPLPNGTGDKGYEHAMHELVVPAISKFMPEMIVLVIGQDSSAFDPNGRECLTMEGYRKIGQIMRQQADQFSGGRLVVVQEGGYHITYAAYCLHATLEGVLCLPHPLLSDPIAYYPEHDIYSERVTFIKNYWQGIISTTDKRN

SEQ ID NO: 419 - protein, 471 aa, Pinus radiata
MEESGNALVSGPDGSKRRVTYFYDADIGNYYYGQGHPMKPHRMRMAHNLIVHYGLHQRMEVCRPHLAQSKDIRAFHTDDYIHFLSSVAPDTQQEQLRQLKRFNVGEDCPVFDGLFNFCQSSAGGSIGAALKLNRKDADIAINWAGGLHHAKKCEASGFCYVNDIVLGILELLKVHQRVLYIDIDIHHGDGVEEAFYTTDRVMTVSFHKFGDYFPGTGHIKDVGYGKGKYYALNVPLNDGIDDESYKHLFRPIIQKVMEVYQPEAVVLQCGADSLSGDRLGCFNLSVKGHADCVRFVRSFNIPLMLVGGGGYTIRNVARCWCYETAVAVGVEPQDKLPYNEYYEYFGPDYTLYVAPSNMENLNTEKDLEKMRNVLLEQLSKIQHTPSVPFQERPPDTEFNDEEEEDMEKRSKCRIWDGEYVGSEPEEDGKLPRFDADTYERSVLKHENKRLVPVSNVEPLKRIKQEEDGAAV

SEQ ID NO: 420 - protein, 432 aa, Pinus radiata; identical to SEQ ID NO: 417

SEQ ID NO: 421 - protein, 731 aa, Pinus radiata
MDLNLVSHGEEEEGVRRRKVGIVYDERMCKHATPEDQPHPEQPDRIRVIWDKLNSAGVLHKCVMVEAKEASEEQLAGVHSRKHIEVMKSIGTARYNKKKRDKLAASYSSIYFSQGSSEAALLAAGSVVEISEKVASGELDAGVAIVRPPGHHAEADKAMGFCLFNNIAIAAKHLVHERPELGVQEVLIVDWDVHHGNGTQHMFWTDPHVLYFSVHRFDAGTFYPGGDDGFYDKIGEGKGAGYNINVPWEQGKCGDADYLAVWDHVLVPVAKSYDPDMVLISGGFDAALGDPLGGCRLTPYGYSLMTKKLMEFAGGKIVLALEGGYNLKSLADSFLACVEALLKDGPSRSSVLTHPFGSTWRVIQAVRKELSSFWPALNEELQLPRLLKDASESFDKLSSSSSDESSASEDEKKIAEVTSIMEVSPDPSSILALTAEDIAQPLAGLKIEEAGTDSQRSSDHTLLDLTNDDTQKLKQFEGEIFVMIGDEESVPSASSSKDQNESTVVLSKSNIKAHSWRLTFSSIYVWYASYGSNMWNPRFLCYIEGGQVEGMAKRCCGSEDKTPPQRIQWKVVPHRMFFGRSYTNTWGSGGVSFLDPNCSDTSEAHVCLYKITLAQFNDLLLQENNLNCGTEHPLVDLSSIDAIRNGNSILELIKDSWYGTLIYLGMEGGLPIVTFTCSVCDVEKFKHGQLPLCPPSSRYENILIRGLVQGKKLSEDDATAYIRAASTSPLL

SEQ ID NO: 422 - protein, 562 aa, Pinus radiata
MADEDLDLSDVGEVEDEPGEEIESTPPLAVGQEKEINSLALKKKLLKVGTRWETPENGDEVTVHYTGTLPDGTKFDSSRDRGEPFTFKLGQGQVIKGWDQGIVTMKKGERALFTIPPELAYGSSGVRPTIPPNATLQFDVELLSWTNIVDVCNDGGILKRIISEGEKYERPKDPDEVTVKYEAKLEDGTLVAKSPEEGVEFYVNDGHFCPAIAKAVKTMKRGESVILTIKPTYAFGERGKDAEEGFAAIPPNATLTTSLELVSFKAVIAVTEDKKVIKKILKEADGYDKPSDGTVVQIRYTAKLQDGTIFEKKGYEGEEPFQFVVDEEQVIAGLDKAVETMKTGEIALITIGAEYGFGNFETQRDLAVIPPNSTLIYEVEMISFTKEKESWDMDTTEKIEASKQKKEQGNSLFKVGKYQRAAKKYEKAAKYIEHDSSFSAEEKKQSKVLKVSCNLNHAACRLKLKDFKEAVKLCSKVLELESQNVKALYRRAQAYIETADLDLAEFDIKKALEIEPQNREVQLEYKILKQKQIEYNKKDAKLYGNMFAKLNKLEAFEGKVLS

SEQ ID NO: 423 - protein, 560 aa, Pinus radiata
MADEGLELSDVAEVEDEPGEEFESAPPLVVGQEKELNSSGLKKKLLKAGTRCETPENGDEVTVHYTGTLLDGTKFDSSRDRGEPFTFNIGQGQVIKGWDQGIVTMKKREHALFTIPPELAYGASGMPPTIPPNATLQFDVELLSWTNIVDVCKDGGILKRIISDGEKYERPKDPDEVTVKYEAKLEDGMLVAKSPEEGVEFYVNDGNFCPAIVKAVKTMKKGENVTLTIKPAYAFGEQGKDAEEGFAAIPPNATITINLQLVSFKAVKEVTEDKKVIKKILKEADGYDKPSDGTVVQIRYTAKLQDGTIFEKKGYAGEEPFQFVVDEEQVIAGLDKAVETMKTGEVALITIGPEYGFGNIETQRDLAVIPPYSTLIYEVEMVSFTKEKESWDMNTTENIEASKQKKEQGNSLFKVGKYLRAAKKYDKAAKYIEHDNSFSAEEKKQSKVLKVSCNLNHAACCLKLKDFKKAVKLCSKVLELESQNVKALYRRAQAYIETADLDLAEFDIKKALEIEPQNREVRLEYLILKQKQIEYNKKDAKLYGNMFARQNKLEAIEGKD

SEQ ID NO: 424 - protein, 172 aa, Pinus radiata; identical to SEQ ID NO: 317

SEQ ID NO: 425 - protein, 172 aa, Pinus radiata
MPNPKVFFDMQVGGAPAGRIVMELYADVVPKTAENFRALCTGEKGNGRSGKPLHFKGSSFHRVIPGFMCQGGDFTRGNGTGGESIYGEKFADENFVKKHTGPGILSMANAGPNTNGSQFFICTAQTSWLDGKHVVFGQVVEGLEVVRDIEKVGSGSGRTSKPVVIADSGQLA

SEQ ID NO: 426 - protein, 172 aa, Pinus radiata; identical to SEQ ID NO: 317

SEQ ID NO: 427 - protein, 172 aa, Pinus radiata; identical to SEQ ID NO: 317

SEQ ID NO: 428 - protein, 578 aa, Pinus radiata
MADDFELPESAGMMENEDFGDTVFKVGEEKEIGKQGLKKLLVKEGGSWETPETGDEVEVHYTGTLLDGTKFDSSRDRGTPFKFKLGQGQVIKGWDQGIATMKKGENAVFTIPPDLAYGESGSQPTIPPNATLKFDVELLSWASVKDICKDGGIFKKIIKEGEKWEHPKEADEVLVKYEARLEDGTVVSKSEEGVEFYVKDGYFCPAFAIAVKTMKKGEKVLLTVKPQYGFGHQGREAIGNDVARSTNATLLVDLELVSWKVVDEVTDDKKVLKKILKQGEGYERPNDGAVVKVKYTGKLEDGTIFEEKGSDEEPFEFMAGEEQVVDGLDRAVMTMKKGEVALVSVAAEYGYQTEIKTDLAVVPPKSTLIYEVELVSFVKEKESWDMNTAEKIEAAGKKKEEGNALFKVGKYFRASKKYEKATKYIEYDTSFSEEEKKQSKPLKVTCNLNNAACKLKLKDYTQAEKLCTKVLEVESQNVKALYRRAQAYIQTADLELAELDIKKALEIDPNNRDVKLEYRALKEKQKEYNKKEAKFYGNMFARMSKLEELESRKSGSQKVETANKEEGSDAMAVDGESA

SEQ ID NO: 429 - protein, 233 aa, Pinus radiata
MAASLTPLGAGLAYATIYDQAKVRKLEPTKRSLIALCQHSDSQHRRFITRKYHVNVQILNRRDAIRLIGLAAGLCIDLSLMYDARGAGLPPQENAKLCDTTCEKELENAPMITTESGLQYKDIKIGNGPSPPIGFQVAANYVAMVPSGQVFDSSLDKGQPYIFRVGSGQVIKGLDEGLLSMKVGGKRRLYIPGPLAFPKGLNSAPGRPRVAPSSPVIFDVSLEFIPGLESEEE

SEQ ID NO: 430 - protein, 262 aa, Pinus radiata
MSAASLSADMAIRGTILGKTALHVLGPQVVSQCRQPVMFKCPPHTLRKMRFSAQDLQSKNFYSGFTPFKSVFISTSKRSWQAGSARAMSQDAAFQSKVTTKCFLDIEIGGDPAGRIVLGLFGEDVPKTAENFRALCTGEKGFGYKGSSFHRIIKDFMLQGGDFDRGDGTGGKSIYGRTFEDENFKLAHVGPGVLSMANAGPNTNGSQFFICTVKTPWLDKRHVVFGQVIEGMEIVKKLESEETNRTDRPKRPCRIVDCGELP

SEQ ID NO: 431 - protein, 232 aa, Pinus radiata
MGRIKPQTLLQQSKKKKVPGRISVSTIIVCNLIIIFLMFSLVGIYRQRAKRNRATSRSDGDEEMENFGRSKINSVPHQAIVNTTKGLITLELFGKSSAHTVEKFVEWSERGYFNGLPFYRVIKHFVIQVGDPKFAGNREDWTVGGQLNVQLEFSPKHEAFMLGTSKLEDQGDGFELFITTAPIPDLNDKLNVFGRVIKGQDVVQEIEEVDTDEHFQPKSPIIINDVRLKDEL

SEQ ID NO: 432 - protein, 188 aa, Pinus radiata
MARQSTLLLFWSLVFLGAIVFTQAKHEELEEVTHKVYFDVDIAGKPAGRVVIGLFGKAVPKTVENFRALCTGEKGVGKSGKPLHYKGSFFHRIIPSFMIQGGDFTLGDGRGGESIYGTKFADENFKLKHTGPVFITTVTTDWLDGRHVVFGKIISGMDVVYKVEAEGRQSGQPKRKVKIADSGELSMD

SEQ ID NO: 433 - protein, 204 aa, Pinus radiata
MARQSTLLLFWSLVFLGAIVFTQAKHEELEEVTHKVYFDVDIAGKPAGRVVIGLFGKAVPKTVENFRALCTGEKGVGKSGKPLHYKGSFFHRIIPSFMIQGGDFTLGDGRGGESIYGTKFADENFKLKHTGPGFLSMANAGPDTNGSQFFITTVTTDWLDGRHVVFGKIISGMDVVYKVEAEGRQSGQPKRKVKIADSGELSMD

SEQ ID NO: 434 - protein, 376 aa, Pinus radiata
MEMDEIQEQSQPQSSEKQDISQESDTGNDKTINAEKITSENAEVEEDDMLPPKVNTEVEVLHDKVTKQIIKEGSGNKPSRNSTCFLHYRAWAESTMHKFQDTWQEQQPLELVLGREKKELSGFAIGVAGMKAGERALLHVDWQLGYGEEGNFSFPNVPPRANLIYEAELIGFEEAKEGKARSDMTVEERIEAADRRRQQGNELFKEDKLAEAMQQYEMALAYMGDDFMFQLFGKYKDMANAVKNPCHLNMAQCLLKLNRYEEAIGQCNMVLAEDEKNIKALFRRGKARATLGQTDDAREDFQKVRKFSPEDKAVIRELRLLAEHDKQVYQKQKEMFKGLFGQKPEQKPKKLHWFVVFWQWLLSMIRTIFRMRSKTD

SEQ ID NO: 435 - protein, 163 aa, Pinus radiata
MAGAGEGTPEVTLETSMGPITVELYHKHAPKTCRNFLELSRRGYYNNVKFHRVIKDFMVQGGDPTGTGRGGESIYGPRFEDEITRDLKHTGAGILSMANAGPNTNGSQFFISLAPTPWLDEKHTIFGRVCKGMDVVKRLGNVQTDKNDRPIHDVKILRTTVKD

SEQ ID NO: 436 - protein, 539 aa, Pinus radiata
MMDPELMRLAQEQMSKISPDELMKMQRQIMANPDLMRMASENMKNLKPEDIRFAAEQMKNVRKEEMAEISERISRASPEEIEAMKARANLQSAYQLQVAQNLKDQGNQLHARMKYSEAAEKYLQARNNLTGIPFSEAKSLLLASSSNLMSCYLKTGQYEECVQTGSEVLAYDAMNVKALYRRGQAYKQIGKLELAVADLRKAVEVSPEDETIAQALREASTELMEKGGTQDQNGPRIEEIIEEEAVQPTAEKYPQSAPMVTSVTEDVSDDEQGSEDQNGFSRDSFQATNAPDGQMYAESLRNLTENPDMLRTMQSLMKNVDPDSLVALSGGKLSPDMVKTVSGMFGRMSPEEIQNMMKMSSTLSRQNPSTSSRFDDITRGHSNMDSSPQSVSVDNDLFEENQNRVGESSTNLSSSAAFSGMPNFSAEMQEQVRNQMNDPATRQMFTSMIQNMSPEMMASMSEQFGVKLSPEDAVKAQNAMASLSPNDLDRLMNWATRLQTAIDYARKIKNWILGRPGLIFAISMLLLAIILHRFGYIGD

SEQ ID NO: 437 - protein, 112 aa, Pinus radiata
MGVEKEILRPGNGPKPRPGQSVTVHCTGYGKNEDLSQKFWSTKDPGQKPFTFTIGQGRVIKGWDEGVLDMQLGEIFKLRCSPDYGYGSNGFPAWGIRPNSVLVFEIEVLSVN

SEQ ID NO: 438 - protein, 361 aa, Pinus radiata
MPNPRCYLDITIGEELEGRILVELYSDVVPKTAENFRALCTGEKGIGPHTGVPLHYKGLPFHRVIKGFMIQGGDISAQNGTGGESIYGLKFDDENFQLKHERRGMLSMANSGPNTNGSQFFITTTRTSHLDGKHVVFGKVIKGMGVVRGIEHTPTESNDRPSLDVVISDCGEIPEGSDDGIANFFKDGDLYPDWPADLDEKSAEISWWMNAVDSAKCFGNENYKKGDYKMALRKYRKALRYLDICWEKEEIDEEKSNHLRKTKSQIFTNSSACKLKLGDLKGALLDTEFAMRDGEDNVKALFRQGQAYMALKDVDSAVASFKKALQLEPNDAGIRKELAVATKMINDRRDQERRAYARMFQ

SEQ ID NO: 439 - protein, 190 aa, Pinus radiata
MGDVIDLNGDGGVLKTIIRSAKPGAMQPTEDLPNVDVHYEGTLADTGEVFDTTREDNTLFSFELGKGTVIKAWDIAVKTMKVGEVARITCKPEYAYGSAGSPPDIPENATLIFEVELVACKPRKGSTFGSVSDEKARLEELKKQREIAAASKEEEKKRREEAKATAAARVQAKLEAKKGQGRGKGKSKGK

SEQ ID NO: 440 - protein, 247 aa, Pinus radiata
MGLGLKIASASFLPIFNIMATRSLCILLVCFIPVLAHVLSLQDPELGTVRVYFQTTYGDIEFGFFPHVAPKTVEHIYKLVRLGCYNSNHFFRVDKGFVAQVADVVGGREVPLNSEQRKEGEKTIVGEFSEVKHVRGILSMGRYSDPDSASSSFSILLGNAPHLDGQYAVFGKVTKGDDTLKRLEEVPTRQEGIFVMPLERIRILSTYYYDTNERESNLTCDHEVSILKRRLVESAYEIEYQRRKCLP

SEQ ID NO: 441 - protein, 162 aa, Pinus radiata
MASKRSLRTMNVWPTLPPLVLLLLLCFSSMSSSVVAKKSDVSELQIGVKHKPKSCDIQAHKGDRIKVHYRGSLTDGTVFDSSFERGDPIEFELGSGQVIKGWDQGLLGMCVGEKRKLRIPSKLGYGAQGSPPKIPGGATLIFDTELVAVNGKGISNDGDSDL

SEQ ID NO: 442 - protein, 373 aa, Pinus radiata
MSGAPAERPISYFDITIGGKPIGRIVFSLYADLVPKTAENFRALCTGEKGIGKSGKPLCYAGSGFHRVIKGFMCQGGDFTAGNGTGGESIYGEKFEDEAFPVKHTKPFLLSMANAGKDTNGSQFFITVSQTPHLDDKHVVFGEVIKGKSIVRAIENYPTASGDVPTSPIIISACGVLSPDDPSLAASEETIGDSYEDYPEDDDSDVQNPEVALDIARKIRELGNKLFKEGQIELALKKYLKSIRYLDVHPVLPDDSPPELKDSYDALLAPLLLNSALAALRTQPADAQTAVKNATRALERLELSDADKAKALYRRASAHVILKQEDEAEEDLVAASQLSPEDMAISSKLKEVKDEKKKKREKEKKAFKKMFSS

SEQ ID NO: 443 - protein, 235 aa, Pinus radiata
MASSLRSSLFSSWALDSKSVCSLFNLNPGKMGLPSISTPLNWRTCCCSHSSELLELNEGLQSSRRKTVMGLSTVIALSLVYCDEVGAVSTSKRALRSQKVPEDEYTTLPNGLKYYDLKVGSGTEAVKGSRVAVHYVAKWKGITFMTSRQGMGITGGTPYGFDVGASERGAVLKGLDLGVQGMRVGGQRILIVPPELAYGNTGIQEIPPNATLEFDVELISIKQSPFGSSVKIVEG

SEQ ID NO: 444 - protein, 583 aa, Pinus radiata
MGAIEDEEPPLKRLKVSSPGLRRGLEEEAPSLSVGSVSILMAKSLSLEEGETVGSKGLIRRVEFVRIITQALYSLGYQKAGALLEEESGILLQSSNVALFRKQILDGKWDESVVTLRGIDQVEVEGNTLKAASFLILQQKFFELLDKGNIPEAMKTLRLEISPMQLNTKRVHELASCIVFPSRCEELGYSKQGNPKSSQRMKVLQEIQQLLPPSIMIPEKRLERLVEQALNVQREACIFHNSLDPALSLYTDHQCGRDQIPTTTLQVLESHKNEVWFLQFSNNGKYLASASKDCSAIIWEITEGDSFSMKHRLSAHQKPVSFVAWSPDDKLLLTCGIEEVVKLWNVETGECKLTYDKANSGFTSCGWFPDGERFISGGVDKCIYIWDLEGKELDSWKGQGMPKISDLAVTSDGKEIISICGDNAIVMYNLDTKTERLIEEESGITSLCVSKDSRFLLLNLANQEIHLWDIGARSKLLLKYKGHRQGRYVIRSCFGGSDLAFVVSGSEDSQVYIWHRGNGELLAVLPGHSGTVNCVSWNPVNPHVFASASDDYTIRIWGVNRNTFRSKNASSSNGVVHLANGGP

SEQ ID NO: 445 - protein, 494 aa, Pinus radiata
MPGTTAGAGIEPIEPQSLKKLSLKSLKRSFDLFASLHGEPQPPDQRSQRIRIACKVRAEYEVVKNLPTLPQREVGSSVSNSNVGETHSSLTTNQAQGFPTDTSGDLSKDEGKEITSIAVHLQPQTGLIDGKAGAIAGTSTAISSVGSSDRYQPSAAIMKRLPSKWPRPIWHPPWKNYRVISGHLGWVRSVAFDPGNEWFCTGSADRTIKIWEVATGKLKLTLTGHIEQIRGLAVSSRHPYLFSAGDDKQVKCWDLEYNKAIRSYHGHLSGVYCLALHPTLDILCTGGRDSVCRVWDIRTKAQIFALSGHENTVCSVFTQAIDPQVVTGSHDTTIKLWDLAAGKTMSTLTYHKKSVRAIAKHPFEHTFASASADNIKKFKLPKGEFLHNMLSQQKTIVNAMAINEDNVLVSAGDNGSLWFWDWKSGHNFQQAQTIVQPGSLDSEAGIYALQYDITGSRLVSCEADKTIKMWKEDETATPESHPINFKAPKDIRRF

SEQ ID NO: 446 - protein, 326 aa, Pinus radiata
MRPILMKGHERPLTFLKYNRDGDLLFSCAKDHTPTVWYGHNGERLGTYRGHNGAVWCCDVSRDSTRLITSSADQTAKLWNVETGAQLFSFNFESPARAVDLAIGDKLVVITTDPFMELPSAIHIKRIEKDLSKQTADSVLTITGIKGRINRAVWGPLNSTIISGGEDSVVRIWDSETGKLLRESDKETGHQKPITSLCKSADGSHFLTGSLDKSARLWDIRTLTLIKTYVTERPVNAVAISPLLDHVVIGGGQEASHVTTTDRRAGKFEAKFFHKILEEEIGGVKGHFGPINSLAFNPDGRSFASGGEDGYVRLHHFDPDYFHIKM

SEQ ID NO: 447 - protein, 326 aa, Pinus radiata
MRPILMKGHERPLTFLKYNRDGDLLFSCAKDHTPTVWYGHNGERLGTYRGHNGAVWCCDVSRDSTRLITSSADQTAKLWNVETGNQLFSFNFESPARAVDLAIGDKLVVITTDPFMELPSAIHIKRIEKDLSKQTADSVLTITGIKGRINRAVWGPLNSTIISGGEDSVVRIWDSETGKLLRESDKETGHQKAITSLCKSADGSHFLTGSLDKSARLWDIRTLTLIKTYVTERPVNAVAISPLLDHVVIGGGQEASHVTTTDRRAGKFEAKFFHKILEEEIGGVKGHFGPINSLAFNPDGRSFASGGEDGYVRLHHFDPDYFHIKM

SEQ ID NO: 448 - protein, 525 aa, Pinus radiata
MAENNVGDFIPLDRQEYPSKPAPGAVDSSFWKSFKKKEVSRQIAGVTCINFCPEPPHDFAVTSSTRVHIYDGKSCELKKTITKFKDVAYSGVFRSDGQIIAAGGETGVIQVFNAKSQMVLRQLKGHGRPVRVVRYSPQDKLHLLSGGDDSMVKWWDITTQEELLNLEGHKDYVRCGAASPSSVNLWATGSYDHTVRLWDLRNSKTVLQLKHGKPLEDVLFFPSGGLLATAGGNVVKVWDILGGGRPIHTMETHQKTVMAMCISKVPRSGQALGDAPSRLVTASLDGYMKVFDLDHFKVTHSARYPAPILSMGISSLCRTMAVGTSSGLLFIRQRKGQIEDKIHSDSSGLQVNPVNDEKDSAVLKPNQYRYYLRGRSEKPSEGDYVVKRMAKVYFQEYDKDLRHFNHSKALVSALKAADSKGTVAVIEELVARKRLIQTLSILNLDELELLINFLSRFILVPKYSRFLISLTDRVLDARAVDLGKSENLKKQIADLKGIVVQELRVQQSMQELQGIIEPLIRASAR

SEQ ID NO: 449 - protein, 426 aa, Pinus radiata
MDVETSGKPTGNKRTYTRLPRQVCVFWQEGRCTRESCNFLHVDEPGSVKRGGATNGFAPKRSYNGSDERDTLAAGPPGGSRRNISARWGRGRGGIFISDERQKIRNKVCNYWLAGNCQRGEECKYLHSFVMGSDVKFLTQLSGHVKAIRGIAFPSDSGKLYSGGQDKKVIVWDCQTGQGTDIPLNDEVGCLMSEGPWIFVGLPNAVKAWNILTSTELSLVGPRGQVHALAVGNGMLFAGTHDGSILAWKFSPASNTFEPAASLVGHTQAVVSLVSGADRLYSGSMDKTIRVWDLGTFQCLQTLRDHTSVVMSLLCWDQFLLSCSLDNTVKVWVATSSGALEVTYTHNEEHGVLALCGMNDEQAKPVLLCSCNDNTVRLYDLPSFSERGRIFSRNEVRTFQIAPGGLFFTGDATGELKVWNWATQKS

SEQ ID NO: 450 - protein, 377 aa, Pinus radiata
MSVQELRERHAAATAKVNALRERIKAKRLQLLDTDVATYASSNGRTPISFSFTDLVCCRTLQGHTGKVYSLDWTSEKNRIVSASQDGRLIVWNALTSQKTHAIKLPCAWVMTCAFSPSGQAVACGGLDSVCSIFQLNNQLDRDGHLPVSRILSGHRSYVSSCQYVPDGDTHVITGSGDRTCIQWDVTTGQRIAIFGGEFPLGHTADVMSVSISAANPKEFVSGSCDTTTRLWDTRIASRAIRTFHGHEADVNTVKFFPDGLRFGSGSDDGTCRLFDIRTGHQLQVYRQPPRENQSPTVTAIAFSFSGRLLFAGYSNGDCFVWDTILEKVVLNLGELQNTHNGRISCLGLSADGSALCTGSWDKNLKIWAFGGHRKIV

SEQ ID NO: 451 - protein, 452 aa, Pinus radiata
MKVKIISRSTDEFTRERSNDLQRVFRNFDPNLHTQARAQEYVRALNAAKLDKIFAKPFLAAMSGHIDGISAMAKSPRHLKSIFSGSVDGDIRLWDIAARRTVQQFPGHRGAVRGLTVSTEGGRLISCGDDCTVRLWDIPVAGIGESSYGSENVQKPLATYVGKNSFRAVDYQWDSNVFATGGAQVDIWDHDRSEPTNSFAWGSDTVISVRFNPAEKDIFATTASDRSIVLYDLRMASPLNKLIMQTRNNAIAWNPREPMNFTAANEDCNCYSYDMRRMNISTCVHQDHVSAVMDIDYSPSGREFVTGSYDRTVRIFPYNAGHSREIYHTKRMQRVFCVKFSGDATYVVSGSDDANIRLWKAKASEQLGVLLPRERKRHEYLDAVKERFKHLPEIKRIERHRHLPKPIYKAALLRHTVNAAAKRKEERKRAHSAPGSVVTNPLRKKRIVAQLE

SEQ ID NO: 452 - protein, 447 aa, Pinus radiata
MDHYYQDDFDYLVDDEMVDFADDVEDDVRTRRRSDIDSDSENDFDLNNKSPDTTALQAKRGKDIQGIPWNRLNFTREKYRETRLQQYKNYENLPRPRRSRNLDKECTNFERGSSFYDFRHNTRSVKATIVHFQLRNLVWATSKHNVYLMQNYSIMHWSSLKQKGEEVLNVAGPIVPSVKHPGSSPQGLTRVQVSAMSVKDNLVVAGGFQGELICKYLDKPGVSFCTKISHDENGITNAVEIYNDASGATRLMTANNDLAVRVFDTEKFTVLERFSFPWSVNHTSVSPDGKLVAVLGDNADCLLADCKTGKTVGTLRGHLDYSFAAAWHPDGYILATGNQDTTCRLWDVRKLSSSLAVLKGRMGAIRSIRFSSDGRFMAMAEPADFVHLYDTRQNYTKSQEIDLFGEIAGISFSPDTEAFFVGVADRTYGSLLEFNRRRMNYYLDSIL

SEQ ID NO: 453 - protein, 316 aa, Pinus radiata
MAEALVLRGTMEGHTDAVTAIATPIDNSDMIVSSSRDKSILLWNLTKEPEKYGVPRRRLTGHSHFVQDVVISSDGQFALSGSWDSELRLWDLNTGLTTRRFVGHTKDVLSVAFSIDNRQIVSASRDRTIKLWNTLGECKYTIQPDAEGHSNWISCVRFSPSATNPTIVSCSWDRTVKVWNLTNCKLRNTLVGHGGYVNTAAVSPDGSLCASGGKDGVTMLWDLAEGKRLYSLDAGDIIYALCFSPNRYWLCAATQQCVKIWDLESKSIVADLRPDFIPNKKAQIPYCTSLSWSADGSTLFSGYTDGKIRVWGIGHV

SEQ ID NO: 454 - protein, 1152 aa, Pinus radiata
MAAIKSTSRSASVAFAPDAPLLAAGTMAGAIDLSFSSLANLEIFKLDFQSDDPELPVVGECPSNERLNRLSWGSAGGSFGIIAGGLVDGTINIWNPATLINSEDNGDALIARLEQHTGPVRGLEFNTISTNLLASGAEDGELCIWDLANPTAPTHFPPLKGVGSGAQGEISFLAWNRKVQHILASTSYSGTTVVWDLRRQKPIISFPDATRRRCSVLQWNPDASTQLIVASDDDNSPTLRAWDLRNTISPYKEFVGHSRGVIAMSWCPSDSLFLLTCAKDNRTLCWDTGSGEIVCELPAGANWNFDVQWSPKIPGILSTSSFDGKIGIHNIEACSRNVSGEVEFGGAIVRGGPSALLKAPKWLERPAGVSFGFGGKLASFRPSTVAQAADHRHSEVFIHNLVTEDNLVIRSTEFEAAIADGEKVSLRALCDRKAEESQSDEEKETWNFLRVMFEDEGTARTKLLEHLGFKVQSEENGDLQETHSSKIDDIGSEIGKTLTLDDKTEEDVLPQLKGGQDAAIPQDNGEDFFDNLHSPKEEVSLSHVGNDFVGEKDKDMVVNGAEIEHETEDLTEYSDWNEAIQHSLVVGDYKGAVLQCLSANRMADALIIAHLGGNSLWEKTRDEYLKKAKSSYLKVVSAMVNNDLTGLVNSRPLKSWKETLAMLCTYSQREEWTVLCDMLASRLIAAGNVMAATLCYICAGNIEKTVEIWSRSLKYDYDGRSFVDHLQDVMEKTVVLALATGQKRVSPSLSKLVENYAELLASQGLLTTAMEYLKLLGTEESSHELSILRDRLYLSGTDNKVEASSFPFETRQDLTESQYNMHQTGFGAPETQKNYQENVHQVLPSGSYTDNYQPTANTHYIAGYQPAPQQQPSFQNYFTPASYQPAPSPNVFYPSQVSQAEQSNFAPPVNQPPMKTFVPSTPPILRNVDQYQTPSLNPQLYQGVSSATVETHPYQTGAPASVSVGTTPGQPSVVPNFMVPGPVTAPTVTPRGFMPVTTPTQHPLGSANPPVQPQSPQSSQVQSVTAATTPPPTIQNVDTSNVAAEIRPVIGTLRRLYDETSEALGGARANPAKRREIEDNSRKIGSLFAKLNSGDISSNAASKLVHLCQALESRDYATAFQIQVGLTTSDWDECSFWLAALKRMIKVKQNMR

SEQ ID NO: 455 - protein, 327 aa, Pinus radiata
MAGAADSQLQTLSERDSTPNFKNLHTREYAAHKKKVHSVAWNCTGTKLASGSVDQTARVWNIEPHGHSKTKDLELKGHADSVDQLCWDPKHSELLATASGDRTVRLWDARSGKCSQQVELSGENINITFKPDGTHIAVGNRDDELTIIDVRKFKPLHKRKFSYEVNEIAWNTTGELFFLTTGNGTVEVLSYPSLQVLHTLVAHTAGCYCIAIDPIGRYFAVGSADALVSLWDLSEMLCVRTFTKLEWPVRTISFNHDGQYIASASEDLFIDIADVQTGRTVHQISCRAAMNSVEWNPKYNLLAFAGDDKNKYMQDEGVFRVFGFETP

SEQ ID NO: 456 - protein, 342 aa, Pinus radiata
MAATSPVGAGSGRELANPPTDGISNLRFSNHSDHLLVSSWDRKVRLYDASANSLKGQFVHGGPVLDCCFHDDASGFSGSADNTVRRYDFSTRKEDILGRHEAPVRCVEYSYAAGQVITGSWDKTLKCWDPRGASGQEKTLVGTYSQLERVYSMSLVGHRLVVATAGRHINVYDLRNMSQPEQRRESSLKYQTRCVRCYPNGTGFALSSVEGRVAMEFFDLSEAGQAKKYAFKCHRKSEAGRDTVYPVNAIAFHPIYGTFATGGCDGYVNVWDGNNKKRLYQYSKYPTSIAALSFSRDGRLLAVASSYTFEEGEKPHEPDAVFVRSVNEAEVKPKPKVYAAPP

SEQ ID NO: 457 - protein, 648 aa, Pinus radiata
MASDDEEGFKNEEAPGVVDEAEVQEGLRACFPLSFGKQEKKQAPLESIHSATKRPEDPRPRRQLGPPRPPPSILAEQEDSDRFVGPPRPPQFVRDDNDDGEAEIMIGPPRPPAQYSDDHDNEETIGPPKPSYLEKGEETDQMVGPSKRGSDDETSGDSDDGDDAVDFRVPLSNEIVLRGHTKVVSALAIDQTGSRVLTGSYDYSVRMYDFQGMTSQLKSFRQLEPAEGHQVRSLSWSPTSDRFLCVTGSAQAKIFDRDGLTLGEFVKGDMYLRDLKNTKGHISGLTCGEWHPKEKQTILTCSEDGSLRIWDVNDFNTQKQVIKPKLAKPGRVPVTACAWGRDGKCIAGGVGDGSIQVWNLKPGWGSRPDLYVAKGHDDDITGLQFSADGNILLTRSTDETLKVWDLRKAITPLQVFRDLPNNYAQTNVAFSPDERLIFTGTSVERDGNSGGLLCFYDRQTLELVLRIGVSPVHSVVRCTWHPRHNQVFATVGDKKEGGAHILYDPALSERGALVCVARAPRKKSLDDFEAKPVIHNPHALPLFRDEPSRKRQREKARMDPMKSQRPDLPVTGPGFGGRVGSTKGSLLTQYLLKEGGLIKETWMEEDPREAILKYADVAAKDPKFIAPAYAQTQPETVFAETDSEEEQK

SEQ ID NO: 458 - protein, 454 aa, Pinus radiata
MKERGQSHAGQPSVDERYTQWKSLVPVLYDWLANHNLVWPSLSCRWGPQMHQATYKNSQRLYLSEQTDGTVPNTLVIATCEVVKPRVAAAEHISQFNEEARSPFVKKFKTIIHPGEVNRIRELPQNSKIVATHTDGPDVLIWDVDTQPNRQATLGAADSRPDLVLTGHKDNAEFALAMSPSAPFVLSGGKDKCVLLWSIQDHISAATEPSSAKASKTPSSAHGEKVPKIPSIGPRGVYKGHKDTVEDVQFCPSNAQEFCSVGDDSALILWDARNGNEPVIKVEKAHNADLHCVDWNPHDENLILTGSADNSVRMFDRRNLTSSGVGSPVHKFEGHSAPVLCVQWCPDKASVFGSAAEDSYLNVWDYEKVGKNVGKKTPPGLFFQHAGHRDKVVDFHWNSFDPWTIVSVSDDGESTGGGGTLQIWRMSDLIYRPEDEVLAELERFRAHILSCQNK

SEQ ID NO: 459 - protein, 1121 aa, Pinus radiata
MSSLSRELVFLILQFLDEEKFKESVHKLEQESGFFFNMKYFDEKAQAGEWDEVERYLSGFTKVDDNRYSMKIFFEIRKQKYLEALDRQDRAKAVDILVKDLKVFSTFNEELYKEITQLLTLDNFRENEQLSKYGDTKSARTIMMSELKKLIEANPLFREKLIYPNLKASRLRTLINQSLNWQHQLCKNPRPNPDIKTLFTDHACGPPNGARTPTQPTASLGVLPKATTFTPIGPHGPFPSSSTATSGLASWMSNPNMVTSPQAPVAVGPSVPVPPNQATLLKRPRTPPGSSSVVDYQTADSEQLIKRLRPVSQSIDEATYPGPTLRVPWSTDDLPKTLARALNEPYPVTSIDFHPSQQTFLLVGTKNGEITLWEVGSREKLATRSFKIWDNANCSNHLEAAFVKDSSVSINRVLWSPDGTLIGIAFTKHLVHTYTFQGLDLRQHLEIDAHVGGVNDLAFSHPNKQLCVVTCGDDKMIKVWDAVTGRKLYNFEGHDAPVYSVCPHHKENIQFIFSTAVDGKIKAWLYDHLGSRVDYDAPGHSCTTMMYSADGTRLFSCGTSKEGESFLVEWNESEGAIKRTYSGLRKKGSGVVQFDTTQNHFLAVGDEHLIKFWDMDSTNMLTSCDAEGGLLNLPRLRFNKEGSLLAVTTVNGIKILANADGQKLLKTMENRTFDLPSRAHIDAASATSSPATGRMERIERTSSANTVSGINGVDPAQSSEKLRLSDDLSEKTKIWKLTEITDSIQCRCITLPENAAEPASKVSRLLYTNSGVGLLALGSNAVHKLWKWNRSEQNPSGKATASVHPQRWQPTSGLLMTNDITDINPEEAVPCIALSKNDSYVMSASGGKVSLFNMMTFKVMTTFMPPPPASTFLAFHPQDNNIIAIGMEDSTIHIYNVRVDEVKTKLKGHQKRITGLAFSSTQNILVSSGADAQLCVWNTETWEKRKSKTIQMPVGKTVSGDTRVQFHSDQLHILVVHETQLAIYDAYKLERQYQWVPQDALSAPILYATYSCNRQLIYATFSDGNIGVYDAEILRPRCRIAPTTYLSSGTSSSTSLPLVVAAHPHEPNQFAIGLSDGAVQVLEPSESEGKWGVSPPPENGVVPAVVAGPSTSNQGSEQAPR

SEQ ID NO: 460 - protein, 422 aa, Pinus radiata
MAKDEEEFRGEMEERLVNEEYKIWKKNTPFLYDLVITHALEWPSLTVQWLPDREEPPGKDYSVQKMILGTHTSDNEPNYLMLAQVQLPLEDAENDARQYDDERGEIGGFGCANGKVQVIQQINHDGEVNRARYMPQNPFIIATKTVSAEVYVFDYSKHPSKPPQDGGCHPDLRLRGHNTEGYGLSWSPFKHGHLLSGSDDAQICLWDINVPAKNKVLEAQQIFKVHEGVVEDVAWHLRHEYLFGSVGDDRHLLIWDLRTSATNKPLHSVVAHQGEVNCLAFNPFNEWVLATGSADRTVKLFDLRKISSALHTFSCHKEEVFQIGWSPKNETILASCSADRRLMVWDLSRIDEFQTPEDALDGPPELLFIHGGHTSKISDFSWNPCEDWVIASVAEDNILQIWQMAENIYHDEEDDMPPEEVV

SEQ ID NO: 461 - protein, 308 aa, Pinus radiata
MSPGVKQTGSQKFESGHQDVVHDVTMDYYGKRIATCSADRTIKLFGLNASDTPSLLASLTGHEGPVWQVAWAHPKFGSMLASCSYDGRVIIWREGQQENEWSQVQVFKEHEASVNSISWAPNELGLCLACGSSDGSITVFTCREDGSWDKTKIDQAHQVGVTAVSWAPASAPGSLVGQPSDPIQKLVSGGCDNTAKVWKFYNGSWKLDCFPPLQMHTDWVRDVAWAPNLGLPKSTIASCSQDGKVVIWTQGKEGDKWEGRILNDFKIPVWRVNWSLTGNILAVADGNNSVTLWKEAVDGDWNQVTTVQ

SEQ ID NO: 462 - protein, 308 aa, Pinus radiata
MSSGVKQTGSQKFESGHQDVVHDVTMDYYGKRIATCSADRTIKLFGMNTSDTPTLLASLTGHEGPVWQVAWAHPKFGSMLASCSYDRRVIIWREGQQENEWSQVQVFKEHEASVNSISWAPHELGLCLACGSSDGSITVFTGREDGSWDKTKIDQAHQVGVTAVSWAPASAPGSLVGQPSDPVQKLVSGGCDNTAKVWKFYNGSWKLDCFPPLQMHTDWVRDVAWAPNLGLPKSTIASCSQDGRVVIWTQGKEGDKWEGKILNDFKTPVWRISWSLTGNILAVADGNNNVTLWKEAVDGEWNQVTTVQ

SEQ ID NO: 463 - protein, 541 aa, Pinus radiata
MKKRSRPSNGHLSTAAKNKSRKTAPITKDPFFDSAHNRNKSKGKGKSRGKGEEIFSSDEDDDAIGRDAPAEEEEEIAEEERETADEKRLRVAKAYLDKIRAITKANEEDNEEEAGEDEETEAERRGKRDSLVAEILQQEQLEESGRVQRQLASRVVTPSKLVECRVVKRHKQSVTAVALTEDDLRGFSASKDGTIIHWDVETGASEKYEWPSQAVSVSSSNEVSKTQKGKGSKKQGSKHVLSMAVSSDGRYLATGGLDRYIHLWDTRTQKHIQAFRGHRGAVSCLAFRQGTQQLISGSFDRTIKLWSAEDRAYMDTLYGHQSEILAVDCLRKERVLSVGRDHTLRLWKVPEETQLVFRGHAASLECCCFINNEDFLSGSDDGSIELWSMLRKKPVFMAKNAHGHAIVENLSEDTSTREEPDEEVTTRQLPNGNSIGNGMTNQMGITPSVESWVGAVTVCRGTDLAASGAGNGVVRLWAIENSSKSLRALHDIPLTGFVNSLTFARSGRFLIAGVGQEPRLGRWGRIQAARNGVTLCPIELS

SEQ ID NO: 464 - protein, 349 aa, Pinus radiata
MAATFGTINTATSPHNPNKSFEIVQPPNDSISSLSFSPKANYLVATSWDNQVRCWEVLQTGASMPKAAMSHDQPVLCSTWKDDGTAVFSAGCDKQAKMWPLLTGGQPVTVAMHDAPIKDIAWIPEMNLLATGSWDKTLKYWDTRQSNPVHTQQLPERCFALSVRHPLMVVGTADRNLIIFNLQNPQTEFKRISSPLKYQTRCVAAFPDKQGFLVGSIEGRVGVHHVEEAQQSKNFTFKCHRDSNDIYAVNSLNFHPVHQTFATAGSDGAFNFWDKDSKQRLKAMARSNQPIPCSTFNSDGSLYAYAVSYDWSKGAENHNPATAKHHILLHVPQESEIKGKPRVTTSGRK

SEQ ID NO: 465 - protein, 403 aa, Pinus radiata
MVVMDKGTHQTNEDESESEFIDEDDVIDEISIDEEDLPDADVEGEDVQEDNKRSEPDENSSSLDDAIHTFEGHEDTLFAVACSPVDATWVASGGGDDKAFMWRIGHATPFFELKGHTDSVVALSFSNDGLLLASGGLDGVVRIWDASTGNLIHVLDGPGGGIEWVRWHPKGHLVLAGSEDYSTWMWNADLGKCLSVYTGHCESVTCGDFTPDGKAICTGSADGSLRVWNPQTQESKLTVKGYPYHTEGLTCLSISSDSTLVVSGSTDGSVHVVNIKNGKVVASLVGHSGSIECVRFSPSLTWVATGGMDKKLMIWELQSSSLRCTCQHEEGVMRLSWSLSSQHIITSSLDGIVRLWDSRSGVCERVFEGHNDSIQDMVVTVDQRFILTGSDDTTAKVFEIGAF

SEQ ID NO: 466 - protein, 316 aa, Pinus radiata
MPVFRTAFNGYAVKFSPFVETRLAVATAQNFGIIGNGRQHVLELTPNGIVEVCAFDSSDGLYDCTWSEANENLVVSASGDGSVKIWDIALPPVANPIRSLEEHAREVYSVDWNLVRKDCFLSASWDDTIRLWTIDRPQSMRLFKEHTYCIYAAVWNPRHADVFASASGDCTVRIWDVREPNATIIIPAHEHEILSCDWNKYNDCMLVTGSVDKLIKVWDIRTYRTPMTVLEGHTYAIRRVKFSPHQESLIASCSYDMTTCMWDYRAPEDALLARYDHHTEFAVGIDISVLVEGLLASTGWDETVYVWQHGMDPRAC

SEQ ID NO: 467 - protein, 508 aa, Pinus radiata
MDSRNRRSRLNLPPGMSPSSLHLETTAGSPGLSRVNSSPSTPSPSRTTTYSDRFIPSRTGSRLNGFALIDKQPQPLPSPTRSAAEGRDDASSSSASAYSTLLRNELFGEDVVGPATPATPEKSTGLYGGSRDSIKSPMSPSRNLFRFKNDHGGNSPGSPYSASTVGSEGLFSSNVGTPPKPARKITRSPYKVLDAPALQDDFYLNLVDWSSNNVLAVGLGTCVYLWSACTSKVTKLCDLGVNDSVCSVGWTPQGTHLAVGTNIGEVQIWDTSRCKKVRTMGGHCTRAGALAWSSYILSSGSRDRNILHRDIRVQDDFIRKLVGHKSEVCGLKWSYDDRELASGGNDNQLLVWNQQSAQPLLRFNEHTAAVKAIAWSPHQHGILASGGGTADRCLRFWNTATDTRLNCVDTGSQVCNLVWCKNVNELVSTHGYSQNQIMVWRYPSMSKLATLTGHTLRVLYLAISPDGQTIVTGAGDETLRFWSIFPSPKSQSAVHDSGLWSLGRTHIR

SEQ ID NO: 468 - protein, 350 aa, Pinus radiata
MEKKKVVVPIVCHGHSRPIVDLFYSPVTPDGLFLISASKDSSTMLRNGETGDWIGTFEGHKGAVWSCCLDNRALRAASGSADFSAKIWDALTGDELHCFVHKHIVRACAFSESTSLLLTGGHEKILRIFDLNRPDAPPKEVDNSPGSIRTVAWLHSDQTILSSNSDAGGVRLWDLRTEKIVRVLETKSPVTSAEVSQDGRYITTADGNSVKFWDANHFGMVKSYTMPCMVESASLEPTMGNMFVAGGEDMWVRLFDFHTGEEIACNKGHHGPVHCVRFAPGGESYSSGSEDGTIRIWQTLNMNSEENESYGVNGLSGKVRVGVDDVVQKVEGFQITADGHLNDKPEKPNP

SEQ ID NO: 469 - protein, 339 aa, Pinus radiata
MERYSQGTQKKSEIYTYEAPWQIYGMNWSVRKDKKFRLGIGSFLEEYNNRVEIIELDEESGEFKSDPRLAFDHPYPTTKIMFVPDKECQRPDLLATTGDYLRIWQVCEDRVEPKSLLNNNKNSEFCAPLTSFDWNDADPKRIGTSSIDTTCTIWDIEKEVVDTQLIAHDKEVYDIAWGEVGVFASVSADGSVRVFDLRDKEHSTIIYESSQPETPLLRLGWNKQDPRFIATILMDSCKVVILDIRFPTLPVAELQRHQASVNTIAWAPHSPCHICTAGDDSQALIWELSSVSQPLVEGGGLDPILAYTAAAEINQLQWSSMQPDWVAIAFSNEVQILRV

SEQ ID NO: 470 - protein, 366 aa, Pinus radiata
MQSENNLDESLHLREVQELQGHTDTVWAVAWNPVTGIDGAPSMLASCSGDKTVRIWENTHTLNSTSPSWACKAVLEETHTRTVRSCAWSPNGKLLATASFDATTAIWENVGGEFECIASLEGHENEVKSVSWSASGMLLATCGRDKSVWIWDVQPGNEFECVSVLQGHTQDVKMVQWHPNRDILVSASYDNSIKVWAEDGDGDDWACMQTLGNSVSGHTSTVWAVSFNSSGDRMVSCSDDLTLMVWDTSINPAERSGNAGPWKHLCTISGYHDRTIFSVHWSRSGLIASGASDDCIRLFSESTDDSVTPVDGTSYKLILKKEKAHSMDVNSVQWHPSEPQLLASASDDGRIKIWEVTRINGLANSH

SEQ ID NO: 471 - protein, 800 aa, Pinus radiata
MKRAYKLQEFVAHASNVNCLKIGKKSSRVLVTGGEDHKVNMWAIGKPNAILSLSGHSSAVESVTFDSAEALVVAGAASGTIKLWDLEEAKIVRTLTGHRSNCISVDFHPFGEFFASGSLDTNLKIWDIRRKGCIHTYKGHTRGVNSIRFSPDGRWVVSGGEDNIVKLWDLTAGKLMHDFKCHEGQIQCMDFHPQEFLLATGSADRTVKFWDLETFELIGSAGPETTGVRAMIFNPDGRTLLTGLHESLKVFSWEPLRCYDAVDVGWSKLADLNIHEGKLLGCSYNQSCVGVWVVDISRVGPYAAGNVSRTNGHNEAKLASSGHPSVQQLDNNLKTNMARLSLSHSTESGIKEPKTTTSLTTTEGLSSTPQRAGIAFSSKNLPASSGPPSYVSTPKKNSTSRVQPTTNFQTLSRPDIVPVIVPRSNSLRPETTSDVKKEMNNFGRVVPSTVSTKSTDVIKSGSNRDESDKIDSINQKRMTGNDKTDLNIARAEQHVSSRLDNTNTSSVVCDGNQPAARWIGAAKFRRNSPVDPVVSPHDRSPTFPWSATDDGVTCQPDRQVTAPELSKRVVEPGRARALVASWETREKALTADTPVLVSGRPPTSPGVDMNSFIPRGSHGTSESDLTVSDDNSAIEELMQQHNAFTSILQARLTKLQVIRRFWQRNDLKGAIDATGKMGDHSVSADVISVLIERSEIFTLDICTVILPLLTRLLQSETDRHLTVAMETLLVLVKTFGDVIRATISATPTIGVDLQAEQRLERCNLCYVELENIKQILVPLIRRGGAVAKSAQELSLALQEV

SEQ ID NO: 472 - protein, 513 aa, Pinus radiata
MSTLEIEARDVIKIVLQFCKENSLHQTFQTLQNECQVSLNTVDSLETFVADINSGRWDVILPQVAQLKLPRKKLEDLYEQIVLEMIELRELDTARAILRQTQAMGFMKQEQPERYLRLEHLLVRTYFDPREAYHESSKEKRRSQIAQALASEVTVVPPSRLMALIGQSLKWQQHQGLLPPGTQFDLFRGTAAVKADEEEMYPTTLAHTIKFGKQSHPECARFSPDGQYLVSCSVDGFIEVWDYISGKLKKDLQYQADDSFMMHDDAVLCVDFSRDSEMLASGSQDGKIKVWRIRTGQCLRRLERAHSQGVTSLSFSRDGSQLLSTSFDSTARIHGLKSGKALKEFRGHTSYVNDAIFTSDGGRVITASSDCTVKVWDVKTTDCIQTFKPPPPLKGGDVSVNSVHLFPKNSEHIVVCNKASSIYIMTLQGQVVKSFSSGKREGGDFVAACISPKGEWIYCVGEDRNIYCFSQQSGKLEHLMKAHDKDIIGVTPHPHRNLLVTYSEDSTMKIWKP

SEQ ID NO: 473 - protein, 353 aa, Pinus radiata
MDIELEDQPFDLDFHPSAPIVAVALITGRLQLFRYVDISSEPERLWTVTAHTESCRAARFINAGSSVLTASPDCSILATNVETGQPVARLDNAHGAAINCLTNLTESTIASGDENGIIKVWDTRQNSCCNKFKAHEDYISDMEFVPDTMQLLGTSGDGTLSVCNLRKNKVHARSEFSEDELLSVALMKNGKKVVCGSQEGVLLLYSWGYFKDCSDRFVGHPHSVDALLKLDEDTVLTGSSDGIIRVVSILPNKMIGVIGEHSSYPIERLAFSHDRNVLGSASHDQILKLWDIHYLHEDDEPETNKQEAVNDENVDMDLDVDTEKRPRGSKRKKRAEKGQTSSQKQSSDFFADI

SEQ ID NO: 474 - protein, 488 aa, Pinus radiata
MDRIQQIPHTCVARKINLPLGMSKESLALNLPANLAPTMSPPSITYSDRFIPSRKASNFEEFALPDKTSPSPNSAGGQSSSTNGEGRDDACAAYSALLRTELFPATPDKTEGCRRPVIGSPSGNVFRFKSQQCKSQSPFSLCPVGEDGDLSETGAVARKTTRKIPRSPFKVLDAPALQDDFYLNLVDWSSHNILAVGLSACVYLWSASSSKVTKLCDLGLDDNVCSVAWTQRGTYLAVGTNNGGVQIWDAAHCKQVRTMEGHCTRVGTLAWNSHILSSGGRDRNILQRDIRAQDDFVSKFSGHKSEVCGLKWSYDNRELASGGNDNQLFVWNQQSQQPVLKYNEHTAAVKAIAWSPHQHGLLASGGGTADRCIRFWNTATNTSLNCVDTGSQVCNLVWSKNVNELVSTHGYSQNQIIVWRYPTMSKLATLTGHTLRVLYLAISPDGQTIVTGAGDETLRFWNVFPSSKTQQNTIRDMGVWSSGRTHIR

SEQ ID NO: 475 - protein, 348 aa, Pinus radiata
MAGGQGEGEEKVDKLSMELTEDVMKSMEIGAVFKDYNGKINSLDFHRTNNYLVTASDDEAIRLFDTASATWQKTSYSKKYGVDLICFTNHQTSVLYSSKNGWDESLRHLSLMDNKYLRYFKGHHDRVVSLCMSPKGECFMSGSLDRTVLLWDLRIDKCQGLIRVRGRPAVAYDEQGLVFAISNEGGLIKMFDARLYDKGPFDTFVVEGDKSEASGIKFSNDGKLILLSTMDSNIHVLDAYQGTTVHSFSVEAVPNGGEAVPNGGTLEASFSPDGKFVISGSGNGNIHAWSVNSGKEVACWTTEGVIPAVVKWAPRRLMFASGSSVLSLWVPDLSKLASLTGSNSNSAY

SEQ ID NO: 476 - protein, 765 aa, Pinus radiata
MHRVGSTGNTSNSSRPRREKRLTYVLNDANDSRHCSGINCLVISKLSLLGGNDYLFSGSRDGTLKRWELADDSAVCSATFESHVDWVNDAVLTGETLVSCSSDTTLKTWRPFSDGVCTRTLRQHSDYVTCLAAASKNSNIVASGGLGREVFIWDIEAAMAPVSRTSEAMDDDTSNGVLSSGNSVLSTTVRSTNATNSASLHTSQLQGYTPIAAKGHKESVYALAMNDVGTLLVSGGTEKVVRVWDPRSGAKQMKLRGHTDNVRALILDSTGRFCLSGSSDSIIRLWDLGQQRCVHSYAVHTDSVWALASTPNFSHVYSGGRDLSLYLTDLTTRESLLLCMEKHPLLRLTLQDDSIWVATTDSSLHRWPAEGQNPPKMFQRGGSFLAGNLSFTRARACLEGSAPVPVNTQPSFVIPGSPGIVQHEILNNRRHVLTKDAEGTVKLWEITRGAVLDDYGKVSFEEKKEELFEMVSIPAWFTMDTRLGSMSVHLDTPQCFTAEMYAVDLNVPDAPEEQKINLAQETLRGLLAHWLSRRRQRLATQASANGDFPAGQENALRNHISSRIDVHDDAETHIAGILPAFDFSTTSPPSIITEGSQGGPWRKKITDLDGTEDEKDFPWWCLECVLHGRLSPRESLKCSFYLHPYEGTTVQVLTQGKLSAPRILRIQKVINYVLEKMVLDRPLDSSNSETTFTPGLSGNQSHAAVVGDGSLRSGARVWQQKAKPLVEILCNNQVLSPDMSLATVRTYIWKKPDDLYLYYRLVQNR

SEQ ID NO: 477 - protein, 964 aa, Pinus radiata
MMKGKTIQMQAAHQNHDGETSVACVLWDWHAKHLITAGADNTILIHSYPSSSSSKPITLRHHKNAVTALAINSNVRSLASGSVDHSVKLYSYPGGEFQSNVTRFTLPIRSLAFNKSGELLAAAGDDEGIKLISTIDNSIARVLKGHNGPVTSISFDPKNEFLASSDSDGTVIYWELSTGKPVHTLKKIAPNTTSNPTSLNQISWRPDGEMLAVPGRKSEVSMYDRDTAEKLFSLKGGHSDTICSLAWSPNGKYIATAGTDRQVMVWDADRRQDIDKQRFDNPICSVAWKPSDNALAVIDVLGRFGVWESPIASHMKSPADGAERYDNMEDEEPLMARYEEELEDSVSGSLNEIINDDDDDDEMGKIPRKILQKKPSVKVEKGKEESNAKAFKSGQDSFKLKSAMQEAFQPGATQRQSGKRNFLAYNMLGSVITFDNDGFSHIEVDFHDIGKGCRVPSMTDYFGFTMASLSESGSVFGSPQKGEKNPSTLMYRPFSSWANNSEWSMRFPMGEEVKAVALGSGWVAAVTSLNFLRVFSEGGLQKFVLSMDGPVVTAAGYENLLVVVSHASNPLLSGDQVLSFTVYDISQKTCPLSGRLPLSPGSHLTWLGFSEEGLLSSYDSEGNLRVFTNDYNGCWVPIFSAARERKSETESIWMVGLNSTQVFCVVCKLPDTYPQVAPKPVLSVLNLSLPLACSDLGADDLENEYLRGSLLLSQMQKKAEDAVACGRESNMEEDSIFKMEAALDRCLLRLIANCCKGDKLVRATELARLLSLEKSLQGAIKLVSAMKLPMLAERFNTILEEKILQENMETISCRRLTSEAQDMDTPISISVKQVSYGANLGDSPFLPNRQVEPKHSTPVFSKPDTKIEVDTSEAIAKGCDAQNGNIKSGDAEVQPASHNDSIQKPSNPFAKASNTSANQAVQRNASLLSSIKQMKTATENEGKRKERARSGSLPQKPAKQSKIS

SEQ ID NO: 478 - protein, 794 aa, Pinus radiata
MKQKRKGHQVDDPKYSVQTPQEDDTPNESGPASEEVESSDEEGGNSSNIEDDIIYSSSEEDPVVSSDYEEDEDAESDAEGVTAEQELEGDIDNALQNYMGTLTVLSNFHGENLKNAEGEDTSGDDDDEEEMPKRAEESDSPEDENDERPKRAEESDFSEDEDEERPKRAEESDSSEDEVPSRNTVGDVPLRWYKDEQHIGYDIKGKKIKKQPKKDQLDSFLASTDDSSDWRKVYDEYNDEEVELTKDEIKFISRLRKGTIPHADVNPYEPYVDWFDWKDKGHPLSNAPEPKRRFIPSKWEAKKVVKLVRAIRKGWITFQKAEEKPRFYLMWGDDLKPSEKMANGLSYIPAPKPKLPGHEESYNPPPEYIPTQEEINSYQLMYEEDRPKFIPKRFDSLRNVPAYDRFLSEIFERCLDLYLCPRTRKKRINIDPESLIPKLPKPKDLQPFPSICFLEYKGHTGAVSCISPESSGQWLASGSKDGTVRIWEVETARCLKVWDIGRPIQHIAWNPVSQLSILAVAVDEEVLVLNTGLGSEDSQEKVAELLHVKSKPVSADDLGDNTSLTKWIKHEKFDGIKLTHLKPVHLISWHHKGDYFATVAPDGNTRAVLVHQLSKQQTQNPFKKMQGRVVHVLFHPSRAIFFVATKTHVRVYDLVKQQLVKRLVTGLHEVSSMAVHHKGDNLLVGSKEGKVCWFDMDLSTQPYKTLKNHSKDIHSVAFHDSYPLFASCSDDCKAYVFYGLVYSDLLQNPLIVPLKVLQGHQSVNGMGVLDCQFHPKQPWLFTAGADSVVKLYCN

SEQ ID NO: 479 - protein, 348 aa, Pinus radiata
MMSLKRGFEESLVPAKRQKTELSTVTYGDGPRRTSSLESPIMLLTGHHAAIYTMKFNPTGTVIASGSHEREIFLWNVHGDCKNFMVLKGHKNAVLDLHWTTDGCQIISASPDKTLRAWDVETGKQIKKMAEHSSFVNSCCPSRRGPPLVVSGSDDGTAKLWDLRHRGAIQTFPDKYQITAVGFSDAADKIYSGGIDNEIKVWDLRRGEVTMRLQGHTDTITGMQLSSDGSYLLTNSMDCSLRIWDMRPYAPQNRCVKILTGHQHNFEKNLLKCSWSSDGSKVTAGSADRMVYIWDTTTRRILYKLPGHTGSVNETGFHPTQPIIGSCSSDKQIYLGEIEPNVGYQAVI

SEQ ID NO: 480 - protein, 461 aa, Pinus radiata
MEFSDTYKHTGPCCFSPDARYLAIAVDYRLVIRDVVTLKVVQLYSCMDKISNIEWALDSEYILCGLYKRAMVQAWSLSQPEWTCKIDEGPAGIAHARWSPDSRHIITTSDFQLRLTVWSLVNTACIHIQWPKHASKGVSFTQDGKFAAIATRRDCKDYVNLLSCHTWEVMGTFTVDTIDLADLEWSPNDSAIVVWDSPLEYKVLIYSPDGRCLFKYQAYDSWLGVKTVAWSPCSQFLAVGSYDQTLRTLNHLTWKPFAEFVHVSTVRGPASAVVFKEVEEPWNLDVSGLHLNDDNAHDIQDGKPAEGHSRVRYKVVEFPVNVSSQKHPVDKPNPKQGIGLLAWSRDSQYLFTRNDNMPTALWIWDICRLELAALLIQKEPIRAAAWDPVYPRVALCTGSSHLYMWTPSGACCVNIPLPQFVVSDLKWNPDGTSMLLKDRESFCCTFVPMLPEFNDDETNEE

SEQ ID NO: 481 - protein, 608 aa, Pinus radiata
MAKLIETHSCVPSTERGRGILIAGDAKTNSIIYCNGRSVIMRNLDNPLEASVYGEHSYPATVARFSPNGEWVASGDTSGTVRIWGRGSDHTLKYEYKALAGRIDDLEWSADGQRIVVCGDSKGKSMVRAFMWDSGTNVGEFDGHSRRVLSCSFKPTRPFRVATCGEDFLVNFYEGPPFRFKTSHRDHSNYVNCVRFAPDGSKFITVGSDRKGVIFDGKMGEKIGELSKEGGHTGSIYAASWSPDSKQVLTVSADKSAKIWEISETGNGTVKKTLTFGSQGGADDMLVGCLWLNDYLITVSLGGIVSLLSAVDPDKPPKTISGHMKSINAIALSLQSGQSEVCSSSYDGVIVRWILGVGYAGRVERKDSTQIKCLATIEGELVTCGFDNKVRRVPLLSEQHKESEPIDIGAQPKDLDVAVGCPELTFVSTDAGIIIIRASKIVSTTNVGYAVTAAAISPDGTEAVVGGQDGKLRVYSIKGDTLLEESVLERHRGPINAIRFSPDGSMFASGDLNREAVVWDRITREVKLKNMVYHTARINCIAWSPDSSKVATGSLDTCILIYEVGKPASSRITIKGAHLGGVYGLAFSDQSTVISAGEDACVRVWSLP

SEQ ID NO: 482 - protein, 315 aa, Pinus radiata
MPQPSVILATAGYDHTVRFWEATSGRCYRTLQYPDSQVNHLEITPDKQYLAAAGNPHIRLFEVNSNNPQPVISYDSHTNNVTAVGFQCDGKWMYSGSEDGTVKIWDLRAPGFQREYESRAAVNTVVLHPNQTELISGDQNGNIRVWDLNANSCSCELVPEDTAVRSLTVMWDGSLVVAANNHGTCYVWRLMRGTQTMTNFEPLHKLQAHNSYILKCLLSPEFCEHHRYLATTSSDQTVKIWNVDGFTLERTLTGHQRWVWDCVFSVDGAFLVTASSDSTARLWDLSTGEAIRTYQGHHKATVCCALHDGTDGASC

SEQ ID NO: 483 - protein, 1214 aa, Pinus radiata
MLTKFETKSNRVKGLSFHPKRPWILASLHSGVIQLWDYRMGTLIDKFDEHDGPVRGVHFHKTQPLFVSGGDDYKIKVWNYKMRQCLFTFVGHLDYIRTVHFHNEYPWIVSASDDQTIRLWNWQSRVCISVLTGHNHYVMSASFHPKEDLVVSASLDQTVRVWDISGLRKKTVSPADDLSRLAQMNTDLFGGGDVVVKYVLEGHDRGVNWAAFHTSLPLIVSGADDRQVKLWRMNDTKAWEVDTLRGHTNNVSCVIFHARQDIIVSNSEDKSIRVWDMSKRTSVQTFRREHDRFWILAAHPEMNLLAAGHDSGMIVFKLERERPAYVVYGGSLLYVKDRYLRTYEFATQKDNPLIPIRKPGSIGPNQGPRSLSYSPTENAILICSDADGGAYELYAVPKDSHGRSDTVQEAKKGLGGSAVFVARNRFAVLDKNHNQVTIKNLKNEVTKKFDLPVTADALFYAGTGNLLCRSEDSVFLFDMQQRTVLGEIQTPNVRYVVWSNDMENVALLSKHTIIIASKKLSSTCSLHETIRVKSGAWDDNGIFMYSTLNHIKYCLPNGDSGIIKTLDVPVYITKVSGKSLYCLDRDGKNRVIQIDITECLFKLALSKKKYDYVINMIRNSQLCGQAIIAYLQQKGFPEVALHFVRDERTRFNLAVESGNIEIAVASAKEIDEKDHWYRLGVEALRQGNAGIVEYAYQRTKNFERLSFLYLITGNLDKLSKMLRIAEMKNDVMGQFHNALYLGDIQERIKILEESGHLHLAYATASLHGLADIADRLAADLGGNIPVLPPGKKSSLLMPPAPILHGGDWPLLRVTKGIFEGGLENSTSAAYEEEDEEAAADWGEDIDIENIEGENGEATVLDDQEVKGGEDDEGGWDMEDLELPPDVAAANVGTNQKTLFVAPTLGMPVSQIWMQKSSLAGEHAAAGNFETALRLLTRQLGIKNFSPLKPLFLELYMGSHTFLPSFASVPAFSLALQRGWSESASPNIRGPPALVYRLSVLEEKLTVAYRATTEGRFSEALRLFLNILHTIPVIVVDSRKEIDEVKELIGIAKEYVLGLRMEVKRKEIRDDAVRQQELAAYFTHCNLQKAHLKLALLNAMGISYRCKNYNTAANFARRLLETDPSSNHATKARQVLQVCERNLQDATQLNYDFRNPFVVCGATFTPIYRGQKEVSCPYCMARFVPDIAGKLCSICDLAIVGSDASGLFCFATQTR

SEQ ID NO: 484 - protein, 603 aa, Pinus radiata
MDLLQNYQDDSEDSNPELRNHPPLEDATATSAPAGVENETSSSPDSSPLRLALPAKSCAPDVDETLMALGVPGSEKKNNHNKPIDPTQHSVTFNPSYDQLWAPLYGPAHPYAKDGIAQGMRNHKLGFVEDSAIEPFMFDEQYNTFHRYGYAADPSASLGSHIVGDLESLKKNDGASVYNLPKREHKRQKLEKKMIQKDENEEEEKEVGEEVDNPSTEEWLKKNRKSPWAGKKEGLQTELTEEQKKYAQEHAEKKGDREKGEKVEIVDKTTFHGKEERDYQGRSWIDPPKDAKATNDHCYIPKRWVHTWSGHTKGVSAIRFFPKYGHLLLSAGMDTKVKIWDVFNSGKCMRTYMGHSKAVRDISFSNDGSRFLSAGYDRNIKLWDTETGKVISTFSTGKIPYVVKLHPDEDKQNVLLAGMSDKKIVQWDMNSGEITQEYDQHLGAVNTITFVDNNRRFVTSSDDKSLRVWEFGIPVVIKYISEPHMHSMPSISLHPNTNWLAAQSLDNQILIYSTRERFQLNKKKRFAGHIAAGYACQVNFSPDGRFVMSGDGEGRCWFWDWKTCKVFRTLKCHDNVCIGCEWHPLEQSKVATCGWDGMIKYWD

SEQ ID NO: 485 - protein, 369 aa, Pinus radiata
MARKGLGTDPAIGSLMSSKKRKEYKVTNRFQEGKRPLYAIAFNFIDARYHNIFATAGGTRVTIYQCLEGGAISVLQAYVDDDKDESFYTLSWACDVNGSPLLVAGGHNGIIRVLDVANEKVHKSFVGHGDSVNEIRTQALKPSLILSASKDESVRLWNVQTGICILIFAGAGGHRNEVLSVDFHPSDVYRIASCGMDNTVKIWSMKEFWTYVEKSFTWTDLPSKFPTKYVQFPVFIAAVHSNYVDCTRWLGNFILSKSVDNEVVLWEPYSKEQSTSDGVVDILQKYPVPECDIWFIKFSCDFHYNSMAVGNREGKVYVWELQSSPPNLIARLSHAHCKNPIRQTAISHDGSTILCCCDDGSMWRWDVVQ

SEQ ID NO: 486 - protein, 692 aa, Pinus radiata
MESGAGGSVGARVPSAKPEMLQQPPYSNGDDDNDMERGTAPVPSSNPNTVSKWELDKDFLCPICMQTMKDAFLTACGHSFCYMCIMTHLNNKSNCPCCSLYLTNNQLFPNFLLNKLLKKTSACQMASTASPVENLCLSLQQGAEVSVKELDFLLTLLAEKKRKMEQEEAETNMEILLDFLQRLRQQKQAELNEVQADLHYIKDDILALEKRRLELSRARERYSRKLHMLLDDPMDTTLGHAAIDDGNNVRTAFVRGGQGDAISGKFQQKKAEIKAQASSQGMQKRANFCHSDSQVLPTLSGLTIARKRRVLAQFDDLQECYLQKRRRWATQLRKQCDGGLRKERDGNSISREGYHAGLEEFQSILTTFTRYSRLRVISELRHGDLFHSANIVSSIEFDRDDELFATAGVSRRIKVFDFATVVNEPADVHCPVVEMSTRSKLSCLSWNKCIKSQIASSDYEGIVTVWDVNTRQSVMMYEEHEKRAWSVDFSRTEPTRLISGSDDGKVKVWCTRQETSVLNIDMKANICCVKYNPGSSYYVAVGSADHHIHYYDLRNPSVPLYEFNGHRKTVSYVKFISTNELASASTDSTLRLWDVRDNCLVRTFKGHTNEKNFVGLTVNSEYIACGSETNGVFVYHKAISKPAAWHQFGSPDLDDSDDDTSHFISAVCWKSESPTMLAANSQGTIKVLVLAP

SEQ ID NO: 487 - protein, 943 aa, Pinus radiata
MANYVDSKKNFKCVPALQQFYTGGPFRLSSDGSFLVCACNDEVKVVDLATGSVKNTLEGDSELIVALALTPDNKYLFSASRSTQIKFWDLSSATCKRTWKAHNGPVADMACDASGGLLATAGADRSILVWDVDGGYCTHSFRGHQGVVTTVIFHPDPHCLLLFSGSDDATVRIWDLVAKKCISVLEKHFSTVTSLAISENGWNLLSAGRDKVVNIWDLRDYHCRATIPTYEPLEAVCVLPTGSRLVSVMNQSRALPENRKKSGAAPVYFLTVGERGIVRIWYSEGALCLYEQKSSDAIISSDKDELKGGFVSAVLLPLTQGVMCVTADQRFLFYNLDESDEGKCDLKVSKRLIGYNEEIVDLKFLGDEEKFLAVATNLEQVRMYDLSSMTCVYELSGHTDIVLCLDTVVFSGHSLLASGSKDHTVRIWDTESKSCICVAAGHMGAVGAVAFSKKAKNFFVSGSSDRTIKVWSFASVLDFGGISKSIKLSSQAAVAAHDKDINSVAVAPNDSLICTGSQDRTARIWRLPDLVPVLVLRGHKRGVWCVEFSPVDQCVMTASGDKTIKIWALSDGSCLKTFEGHTASVLRASFLTRGTQFVSSGADGLLKLWTIKSNECIATFDQHEDKIWAMAVGKKTEMLATGGSDSLVNLWHDCTTTDEEEALLKEEEAALKDQELLNALADTDYVKAIQLAFELRRPYKLLNVFTELYSKGHAQDQIQKVIRELGNEELRLLLEYVREWNTKPKFAHVAQFVLFQLFNVLPPKEIIEVQGISELLEGLIPYAQRHYSRIDRLMRSTFLLDYTLSSMSVLSPTETDLSSSNLLARTADPLHAQIDQFHPTHFPEPNLTPIQSLLDSGNTDSVEVTARRAKKKRVSGNDSEKTTVAEVKIGDMENAFDEPDVADQGSSRKHKPASSKKRKSIAVGNASIKRIASGNAVTIALQV

SEQ ID NO: 488 - protein, 464 aa, Pinus radiata
MESSCSSMNSNRHSTEKRCLRPLQKQGASMNKHSSDRFIPARGSIDLDVARFMVTQKQKDNNDIHALSPSPSPSKKAYQKEMADTLLKNAGAADNNCRILSFNGKSSTVSQGSQENVLANLSISRRARRYIPQSADRTLDAPDLLDDYYLNLLDWSSTNVLSTALGNTVYLWDASNSSISELLIADEEEGPVTSVSWAPDGSQIAVGLNNSVVQLWDSQSNKKLRALKGHHDRVGALSWNGPILTTGGLDGIIINHDVRTRDHIVQTYKGHTQEVCGLKWSPSGQQLASGGNDNLLYIWDKSMASHNPSSQYFHQLDEHCAAVKALAWCPFQTNLLASGGGTSDGSIKFWNTQTGACLNTVDTHSQVCSLLWNRHERELLSSHGLNQNQLTLWKYPSMVKITELTGHTARVLHMAQSPDGYTVASAAADETLKFWQVFGAPDASKKTKTKDTKGAFNMFHMHIR

SEQ ID NO: 489 - protein, 399 aa, Pinus radiata
MLDEIVADEEEEFNIWKKNTPLLYDVVITHALEWPSLTVQWLPDRHQSPTKDYSLQKMIVGTHTSGDEPNYLMIAEVQMPLQYSEDGNVGGFESTEAKVHIIQQINHEGEVNRAQYMPQNSFIIATKTVSSDVYVFDYTKHSSNAPQERVCNPELILKGHTNEGYSLSWSPLKEGQLLSGSNDAQICFWDINAASGRKVVEAKQIFKVHEGAVEDVSWHLKHEYLFGSVGDDCHLLIWDTRTAAPNKPQHSVVAHESEVNSLAFNPFNEWLLATGSADKTVKLFDLRKLSCSLHTFSNHTEEVFQIEWSPMNETILASSGGDRRLMVWDLRRIGDEQTSEDAEDGPPELIFIHGGHTSKISDFSWNLHDDWLIASVAEDNILQIWQMAENIYHDDADIL

SEQ ID NO: 490 - protein, 430 aa, Pinus radiata
MTKEDHGESRDEMGERMVNEEYKLWKKNTPFLYDLVITHALEWPSLTVQWLPPSCKQQQDIIKDDDIDHPNTQMVILGTHTSDNEPNYLILAEVQLHDGTEDEDGDGDVKRPQDKMKPGTSGGAMGKVRILQQINHQKEVNRARYMPQKPTIIATKTVNADVYVFDYSKHPSKPPQEGRCNPELRLQGHESEGYGLSWSPLKEGHLLSASDDAQICLWDITAATKAPKVVEANQIFRYHDGPVEDVAWHAIHDHLFGSVGDDHHLLLWDIRNDSEKPLHIVEAHQAEVNCLAFNPFNEWIVATGSADRTVALHDIRKLDKVLHTCAHHMEEVFQIGWSPQNGAILASCGSDRRLMVWDLSRIGDEQNPEDAEEAPPELLFIHGGHTSKISDFSWNPAEEWVIASVAEDNILQVWQMSEHIYNDDNDSPTA

SEQ ID NO: 491 - protein, 401 aa, Pinus radiata
MAMAMGDENAADPVEEFNIWKKNTPFLYDLVITHALEWPSLTVQWLPDRHQSSTADYSLQKMIVGTHTSEDEPNYLMIAEVQIPLQNSEDNIIGGFESTEAKVQIIQKINHEGEVNKARYMPQNSFVIATKTVSSDVYVFDYSKHPSKAPQERVCNPELILKGHSNEGYGLSWSPLKEGYLLSGSNDAQICLWDINAAFGKKVLEANQIFKVHEGAVGDVSWHLKHEYLFGSVGDDCHLLIWDMRTAAPNKPQQSVIAHQSEVNSLAFNPFNEWLLATGSMDKTVKLFDLRKLSCSLHTFSNHTDQVFQIEWSPMNETILASSGADRRLMVWDLARIGETPEDEEDGPPELLFVHGGHTSKISDFSWNLNDDRVIASVAEDNILQIWQMAENIYHDDEDML

SEQ ID NO: 492 - protein, 918 aa, Pinus radiata
MGLFEPFRALGYITDGVPFAVQRRGIETFVTLSVGKAWQIYNCAKLIPVLVGPQMDKKIRALACWRDFTFAATGHDIAVFRRAHQVATWSGHKAKVTLLLSFGQHVLSVDLEGCLFIWAVAEVNQNKPPIGQIQLGEKFSPSCIMHPDTYLNKVLIGSEEGTLQLWNVNTRKKLYEFKGWGSSIRCCVSSPALDVVGIGCSDGKIHVHNLRYDEEIVTFMHSTRGAVTALSFRTDGQPLLAAGGSSGVISIWNLEKKKLQSVIKDAHDSSVCSLHFFANEPVLMSSATDNSIKMWIFDTTDGEARLLKYRSGHSAPPMCIRYYGKGRHILSAGQDRAFRIFSVIQDQQSRELSQGHVGKRAKKLKVKDEEIKLPPVIAFDAAEIRERDWCNVVTCHLDDPCAYTWRLQNFVIGEHILKPCLEDPTPVKSCSISACGNFAVLGTEGGWLERFNLQSGISRGTYIDIGEKRQCAHNGAVVGLACDATNTLLISGGYNGDIKVWDFKGRELKFRWEIEVPLIKIVYHPGNGILATAADDMILRLFDVTAMRLVRIFVGHMDRVTDLCFSGDGKWLLSSSMDGTIRVWDIISSRQLNAMHMDSAVTALSLSPGMDMLATTHVGHNGIYLWANRMIYSKATDIEPFISGKQVVKVSMPTVSSKRESEEGDEKRTIVAESNVNKSDVSGSLIGDSYSAQLTPELVTLALLPKAQWQSLVNLDIIKMRNKPIEPPKKPEKAPFFLPSLPTLSGERIFIPSSMNGDGDQDETRNDKTVFEARGKKLGGESLSFMQLLQSCAKIKDFTTFTNYLKGLSPSAVDMELRLLQIVDNENISETEHSVELQGIGMLLDYFVNEVSCNNNFEFVQALIRLFLKIHGETIRCQVSLQEKARKLLEIQSSTWERLDTSFQNARCMITFLSSSQF

SEQ ID NO: 493 - protein, 501 aa, Pinus radiata
MIAAVCWVPKGVAKVLPDSAEPPTQEEIQELLKCNVVAESDDNEDSDEESEEMDTETDKNTDAVAKALAAANALGSQSSDFQRQHKVDDIANGLKELDMDHYDDEDEGIDIFGSGSLGNCYYPANDMDPYLVEQDDDDEDEIEDMTIKPSDLIILSARNEDDVSHLEVWIYEEETEEGGSNMYVHHDIILPAFPLSLAWLDCNLKGGEKGNFVAVGTMQPEIELWDLDVLDEVEPAVVLGGAVKDEASGKTTKLKKKKKNKQAVNFKEGSHTDAVLGLAWNMEYRNVLASASADKSVKIWDIVAEKCEHTMQPHTDKVQAVAWNPNQATVLLSGSFDRSVIMMDMRAPTHSGIRWPVPADVESLAWDPHTDHSFMVSAEDGTVRGFDIRAAASTADFDGKPMFILHAHDKAVCAISYNPAAPSLLTTGSTDKMVKLWDITNNQPSCIASTNPNVGAVFSAAFSKNSPFLLATGGSKGILHVWDTLDNSEVARRFGKFRPQN

SEQ ID NO: 494 - protein, 483 aa, Pinus radiata
MIMDENEFCDIFSLRKRLCLLSSQEGEEEEELEAMSQLDAGEFTVTGNEEVVAIAEDDVNTGILSQDLFSSQDYCTPSQPQDSTDLDSKDKAPCPLSPVKSTIQRKRCRPELLSNPPDSIQFSFQRLERVRSEESIQSSSQQLARVRSEVSSSDDFKTPKITASGQKNYVSQSALALRARVMSPPCIKNPYLDENEELNEKIQRSTRRSPACVTPIQSGACLSRYRADFHELEEIGRGNFSRVYKALNRLDGCCYAVKCSQSELRLDTERKVALMEVQSLAALGPHKNIVGYHTAWFENDHLYIQMELCDHNLTTANDRGILRTDTDFLEAVYQIAQALEFIHGRGVAHLDVKPENIYVRDGTYKLGDFGRATLINGTLHVEEGDARYMSREILNDNYEHLDKVDMFSLGATFFELLMRKQYPGSGKRIDRDTEIKIPILPGFSIYFQKLLQDLVSNDPGKRPSAKDVLKNPIFNKVRGAKEV

SEQ ID NO: 495 - protein, 487 aa, Eucalyptus sp.
MLAPALEMEPVEPQSLKKLSFKSLKRALDLFSPVHGQIAPPDPESKKMRISYKLNFEYGGGSGSEDQVPKRKESGAAQNQGQQAAGASNALALPGPEGSKIPPMEKSQNALTVGPSLRPQGLNDVGLHGKGTAIISASGSSDRNLSTSAIMERLPSRWPRPVWHPPWKNYRVISGHLGWVRSIAFDPSNQWFCTGSADRTIKIWDLASGRLKLTLTGHIEQIRGLAVSSKHTYMFSAGDDKQVKCWDLEQNKVIRSYHGHLSGVYCLALHPTIDILLTGGRDSVCRVWDIRSKMQIFALSGHDNTVCSVFARPTDPQVVTGSHDTTIKFWDLRHGKTMTTLTNHKKSVRAMAQHPKENCFASASADNIKKFQLPRGEFLHNMLSQQKTIINTMAVNEEGVMATGGDNGSLWFWDWKSGHNFQQAHTIVQPGSLESEAGIYALSYDLTGSRLVSCEADKTIKMWKEDELATPETHPLNFKPPKDIRRF

SEQ ID NO: 496 - protein, 529 aa, Eucalyptus sp.
MEEAAKEQSAGSGKPKLLRYGLRSAAKPKEDKKEEQLHQPPPPPPPQQQAAPAPAPAATRSSTSGSAGGRDRRPQQQHAVDEKYARWKSLVPVLYDWLANHNLLWPSLSCRWGPQLEQATYKNRQRLYISEQTDGSVPNTLVIANCEVVKPRVAAAEHVSQFNEEARSPFIRKYKTIIHPGEVNRIRELPQNPNIVATHTDSPDVLIWDVESQPNRHAVYGATASRPNLILTGHQENAEFALAMCPAEPFVLSGGKDKTVVLWSIQDHITASATDQTTNKSPGSGGSIIKKTGEGNEETGNGPSVGPRGIYCGHEDTVEDVAFCPSTAQEFCSVGDDSCLILWDARIGTNPVAKVEKAHNGDLHCVDWNPHDNNLILTGSADNSVNMFDRRNLTSNGVGSPVYKFEGHKAAVLCVQWSPDKPSVFGSSAEDGLLNIWDYERVDKKVDRAPNAPAGLFFQHAGHRDKIVDFHWNTADPWTMVSVSDDCDTAGGGGTLQIWRMSDLIYRPEEEVLAELENFKAHVLECSKA

SEQ ID NO: 497 - protein, 422 aa, Pinus radiata; identical to SEQ ID NO: 460

SEQ ID NO: 498 - protein, 296 aa, Pinus radiata
MGKYMRKGKGVGEVAVMEVSQGSLGVRTRARTLAAASSQKDHRRLGASKSVTTKHQSSAPPASPCVESSMHTCYLELRSRKLEKFSRCYHSAHGATSHGESKRSLSLSEPSRLAVSEEARVASDKSSHRVLQQQSSVAHSRNNSATFSHNAKPAKAAQRKERRDDDHTSARPSEAPHEDEDGMEVEASFGENVMDLDSRERRTRETTPSSYTRDVETMETPGSTTRPPSNAGRRRFQTEGGHGTRNQFHVPTTNEIEEFFAGAEQQEQRRFTDRYNYDPVSDSPLPGRFEWVRLRP

SEQ ID NO: 499 - protein, 424 aa, Pinus radiata
MQNMEENVQSSWSLHGNKEICARYEILKRVSSGTYLDVYRGRRKEDGLIVALKEVHDYQSSWREIEALQRLCGCPNVVRLYEVILEFLTSDLYSVIKSAKNKGENGIPEAEVKAWMIQILQGLANCHANWVIHRDLKPSNMLISAYGILKLADFGSMSFLKRAIYEVEYELPQEDILADAPGERLMDEDDSVKGVWNEGEEDSSTAVETNFDDMAETANLDLSWKNEGDMVMQGFTSGVGTRWYRAPDFLYGATIYGKEIDLWSLGCILGELLILEPLFSGTSNIDQLSRLVKVLGLQQKKNWPGCSNLPDYRKLCFPGDGSPVGLKNHVPNCSDNMFSILERLVCYDPAARLNAKEIVENKYFVEDPYPVLTHELRVPSPLREENNFSEDWAKWKDMEVDSDLENIDEFNVVHSSDGFCIKFS

SEQ ID NO: 500 - protein, 514 aa, Pinus radiata
MAPVKRIEPEKTKANEGKPKRRKVAFAIDTGIEANDCISLHLVSTPEEMRDAEGVEDQSLSFNPEYMQHFVGEHGKIYGYKGLKIDVWLNALSFHAYVDIQYESKVEEGKSEKEATDLTDIMKRIFGRGLVEDRNAFIQSFSSNSQSIESMIHNEGERIATREILTDKGLSAQGDSERLGVSNEIFRLELSDPQIREWHARLEPLVLLFVEGSQPIEQDDPKWEMYIRVQRESLSGGSAVCRLLGFCTVYRFYHYPDTTRLRISQILVFPPYQGKGHGLLLLEAVNKTAVSRDSYDVTVEEPSESLQELRDCMDTIRLLSFEPVMPAVKSAVQKLKEANPSDKGAADHCLEGNVNNETVTTSSTKPKNKSGWFPPPGLVEEVRKHLKISKKQFKRCWEILLYLNLDRSDSQCEDKYHISLMEQIMSELFDKSSEKSAKGKRVIDIDNEYDNSKTFIMVRTRNPGNGEGFLPEALEGGMEVSQEDQLKSLFEERLEEIAQIAEKVPSLCKALQMP

SEQ ID NO: 501 - protein, 226 aa, Pinus radiata
MPEDRKKILEALAAKRKAEAESGEKKKRQKSSLNPAKPVSKPVSKPVGGIGSKGKSTSAPISSTKAKSKHKEEVKAKRVTKMDRYETDEDDESEEEEDLDSESDDDELSDEDSEDDIKSKSVKKLPPQSKGKAPVKGISSSNGKGRDEKGKGIMKDKGKAKAKVEESSSDAEGDSDDDGGDLSDDPLQEVDPSNILPSKTRRRASQPTNYQFANMSGDDDDDDDSD

SEQ ID NO: 502 - protein, 644 aa, Pinus radiata
MADVPESLQQEKDEQGTDKNCCDGKFQKEIDIDDMEEEYNESSIDDEEENLSDNVATNNMGTIPQGQACMAVTVEGIEHANSVGCGRNGREGSEEVTAAEDMGHVSIENIREQGRNRKSSEQLLALYEQEGLLEDDEDDDDVDWEPFEGVTVQMKWYCTNCTMANSDDSVHCDSCGEHRNSDILRQGFLASPYLPAESPSSSDVPDERLEESKCVMTTLTPSISPMIGVCCSSLQSERRTVVGFDERMLLHSEIQMETYPHPERPDRLRAIAASLRAAGLFPGKCFSIPAREATCEELQTIHSLEHVNAVESTSCGMLSHLSPDTYANEHSSLAARLAAGLCADLAKAIMTGQAQNGFALVRPPGHHAGVKDSMGFCLHNNAAIAVSASRVVGAKKVLIVDWDVHHGNGTQEIFEADQSVLYISLHRHGEGFYPGSGAVTEVGSSKGEGYSVNIPWKCGGVGDNDYIFAFQHAVLPIAEQFEPDLTIISAGFDAAKGDPLGRCEVTPDGFAHMAQMLSCLSKGKMLVILEGGYNLRSISASATAVIKVLLGDNPKALPIDIQPSKGGLQTLLEVFEIQSKYWSSLKGHDQKLRSQWEAQYGSKKRKVIRKRHMHIVGGPVWWKWGRKRVVYYHWFARVSSRKHL

SEQ ID NO: 503 - protein, 190 aa, Pinus radiata
MASGAGAAGVVEWHQKPPNPKNPVVFFDVTIGTIPAGRIKMELFADIVPRTAENFRQFCTGEYRKAGIPIGYKGCHFHRVIKDFMIQAGDFVKGDGSGCISIYGSKFEDENFIAKHTGPGLLSMANSGPNTNGCQFFLTCAKCDWLDNKHVVFGRVLGEGLLVLRKIENVQTGQHNRPKLPCVIAECGEM

SEQ ID NO: 504 - protein, 483 aa, Pinus radiata
MAKLVSSVCAFSCQQRHPHSRPRFLSNRDHYNHYHNHSHYHNVCYFPPMMMMQQQLQKQKRMTTKTITSLFKCNSSNHTLLKGLKEFMGFKFRLQAAMLSCEMSILGRVFAIFFIVHQAAAPFPFNHFDNWLVPPASAVLYSPNTKVPRTGEVALRKSIPANPAMKSIQDFLEDIYYLLRFPQRKPYGTMEGDVKSALQIAINEKDSILGSVPLDMKERGLQLYNFLIDGQGGLQVLIEYIKEKDPDKVSVNLSSSLDTIAQLELLQAPGLPYLLPEEYQQYPRLNGRATIEFTMEKGDNSMFSVSSGGGLQKTATIQVVLDGYSAPLTAGNFTKLVIDGAYNGLKLKTTEQAVISDNERAEAGFNLPIEILPAGGFEPLYRTTLSVQDGELPVLPLSVYGAIAMAHNTISEDYSSPSQFFFYLYDKRNAGLGGLSFDEGQFSVFGYTTVGKEILPQLKTGDIIKSAKLVDGFDHLVLPSSST

SEQ ID NO: 505 - protein, 447 aa, Pinus radiata
MDHYYQDDFDYLVDDEMVDFADDVEDDVRTRRRSDIDSDSENDFDSNNKSPDTTALQAKRGKDIQGIPWNRLNFTREKYRETRLQQYKNYENLPRPRRSRNLDKECTNFERGSSFYDFRHNTRSVKATIVHFQLRNLVWATSKHNVYLMQNYSIMHWSSLKQKGEEVLNVAGPIIPSVKHPGSSPQGLTRVQVSAMSVKDNLVVAGGFQGELICKYLDKPGVSFCTKISHDENGITNAVEIYNDASGATRLMTANNDLAVRVFDTEKFTVLERFSFPWSVNHTSVSPDGKLVAVLGDNADCLLADCKTGKTVGTLRGHLDYSFAAAWHPDGYILATGNQDTTCRLWDVRKLSSSLAVLKGRMGAIRSIRFSSDGRFMAMAEPADFVHLYDTRQNYTKSQEIDLFGEIAGISFSPDTEAFFVGVADRTYGSLLEFNRRRMNYYLDSIL

SEQ ID NO: 506 - protein, 855 aa, Pinus radiata
MDCSGDEEEEQFFESLEEMLSPSDSGSEAADNETGCRNADARSKYEIWKRAPSSIQERRQRFLVRMGLANPSELGNQVNSTSAESTCSTETANIPNGIERLRENSGAVLRTAGSSGRKTHCKNVINIGLREGSVRSSSSSNGTPDVGEDNGEFGGTIFSRSGGTWECMCKIKNLDSGKEFVVDELGQDGLWNKLREVGTDRQLTMDEFERSLGLSPLVQELMRRESGVAQADCNGVHHHDAEISSSKRRSWLKALKSAAYSMRRPKEDQSNYDSERSGRRSGSFDVPWGKPQWTKVRHYRKRYKEFTALYMGQEIEAHEGSIWTMKFSLDGRYLASAGQDCVIHVREVIESMRTFGADTPDLYASSAYFSMNGLQELVPLSIEDHANKMKRGKIIGSKKSSNSDCIVLPNKVFQLSEEPVCSFHGHLLDVFDLSWSPSQYLLSSSMDKTVRLWKLGHESCLKVFSHNDIVTCIQFNPVDERYFISGSLDGKARIWSIPDRQVVDWSDLREMVTAVCYTPDGQGGLVGSIKGSCRFYNTSGNKLQLENQLNVRSKKKKSSGKKITGFQFAPGGDSQKVLITSADSRVRVYNGSELVCKYKGFRNTCSQISASFAPNGQHFVCASEDSRVYIWNHESPRGSGARHEKSSWSHEHFLSQGVSVAIPWSGMKLQPPVWNSPEFMLGQRHNLLSLQGGKDVGCQNGLLSREAGEGQESETPLHYISQVSHSCGSQNMVDRDGQDDLSRYSACISDSRLSSFMAFPESPGNPDDLNSKVFFSDSSSKGSATWPEEKLPPTRKQSRSNSTSSHYDTLKTHLGNTIQGQSGASAAVAWGLVIVTAGHGGEIRSFQNYGLPVRL

SEQ ID NO: 507 - protein, 463 aa, Pinus radiata
MPSIPAIGEFTVCEINRELLTTKDESDTQAKDAYAKILGLVFPPISFQIEEGFGSASRQQFDQDLDREDTIVTPSTSEGTNALQEGGLLLKGVSVLKNILASSFGPIFSPNDTKVLKKVELLQGISWHRHKHILAFISGSNQVTVHDFQDPEWRESSLLVSESQRGIEALEWRPNGGTTLSVACRGGICIWSASYPGSVAPVRSGVASFLGTSTRGSSVRWTLVDFLQIPGGKAVTALSWSPTGRLLASASREDSSFTIWDVAQGVGTPLRRGLGGISLLKWSPTGDYLFSAKPNGTFYLWETNTWTLEQWSSSGGCVISATWGPDGRMLFMAFSESTTLGSLHFAGRPPSLDAHLLPMELPEIGSITGGFGNIEKMAWDGCGERLAVSYTGGDLMYVGLIAIYDTRRTPFISASLVGFIRGPGEQVKPLAFAFHDKFKQGPLLSVCWSSGLCCTYPLIFRAH

SEQ ID NO: 508 - protein, 435 aa, Pinus radiata
MEEENAKHTEETRQVQVRFTTKLQPALRVPTTSIAIPAHLTRYGLSDIVNTLLGNDKPQPFDFLVESELVRTSLEKLLLIKGISAEKILNIEYILAVVPPKQEEPSLHDDWVSVVDGSYPNFIFSGSFDSIGRIWKGEGLCTHVLEGHRDAITSAAFIMPSDSSDSFINLATASKDRTLRLWQFKPNEHMTNGKMVRPYKLLKGHTSSVQTVSACPRRNLICSGSWDCSIKIWQTAGEMDIESNAGSVKKRKLEDSTEQIISQIEASRTLEGHSQCVSSVVWLEKDTIYSASWDHSVRSWDVETGVNSLTVGCRKALHCLSIGGEGSALIAAGGADSVLRIWDPRMPGTFTPILQLSSHKSWITACKWHPKSRHHLISASHDGTLKLWDVRSKVPLTTLEAHKDKVLCADWWKEDCVISGGADSTLQIFSNLNLT

SEQ ID NO: 509 - protein, 203 aa, Pinus radiata
MNRLRSKRNHILELRLGQSEPEKEATLASNRSRGTNAPIVVEDDDDVVVSSPRSFALARSSVSQRSSRIPIVNEEDLELRLGLAVTGRTSAEHNPRRRHGRVPPNKPIVLCDDAGEADQSSSKKRRTGQQLSSDVQSDESKEVKLTCAICISTMEEETSTICGHIFCKKCITNAIHRWKRCPTCRKKLAINNIHRIYISSSTG

SEQ ID NO: 510 - protein, 689 aa, Pinus radiata
MEEPPPPAVLPSSEDTSIVSSHSFVNAPPTVPVGLDASIPQISTPGINQPGLTIPVPPEAAPLTASLVAASAGMPPAVVPSFVRPAIVAHPSVMPPPSMPLAALPMPVASAVPVAAPHFPPSTPNDNSITPSMPVPTPIVASSSVPPSVTIPGIAPLPFIAPIPVPSSRPVAPSPFMPPARPLGASVSVAMDVDNTDEQDQDADNKGESPSSSPDHPEDPSAAEYEITEESRKVRERQEQAIQELLLRRRAYALAVPTNDSSVRARLRRLNEPITLFGEREMERRDRLRALMAKLDAEGQLEKLMKVQEEEEAAANVDAEEVQEMEGPQVYPFYTEGSQELLKARTEITKFSLPRAVSRLQRARRKREDPDEDEDEELKCVLQQSAQINMDCSEIGDDRPLSGCAFSSDGTLLATSAWSGVTKLWSVPNINKVATLKGHTERVTDVAFSPTNCHLATACADRTAMLWNSEGVLMKTYEGHLDRLARLAFHPSGLYLGTASFDKTWRLWDVNTGIELLLQEGHSRSVYGIAFQCDGSLAATCGLDGLARIWDLRTGRSILALEGHVKPVLGIDFSPNGYHLATGSEDHTCRIWDLRKRQSVYIIPAHSHLVSQVKFEPQEGYFLVTASYDSTAKVWSARDFKSIKVLAGHEAKVTSVDITADGQYIATVSHDRTIKLWSSKNSTNDMNIG

SEQ ID NO: 511 - protein, 800 aa, Pinus radiata
MKRAYKLQEFVAHASNVNCLKIGKKSSRVLVTGGEDHKVNMWAIGKPNAILSLSGHSSAVESVTFDSAEALVVAGAASGTIKLWDLEEAKIVRTLTGHRSNCISVDFHPFGEFFASGSLDTNLKIWDIRRKGCIHTYKGHTRGVNSIRFSPDGRWVVSGGEDNIVKLWDLTAGKLMHDFKCHEGQIQCMDFHPQEFLLATGSADRTVKFWDLETFELIGSAGPETTGVRAMIFNPDGRTLLTGLHESLKVFSWEPLRCYDAVDVGWSKLADLNIHEGKLLGCSYNQSCVGVWVVDISRVGPYAAGNVSRTNGHNEAKLASSGHPSVQQLDNNLKTNMARLSLSHSTESGIKEPKTTTSLTTTEGLSSTPQRAGIAFSSKNLPASSGPPSYVSTPKKNSTSRVQPTTNFQTLSRPDIVPVIVPRSNSLRPETTSDAKKEMNNFGRVVPSTVSTKSTDVIKSGSNRDESDKIDSINQKRMTGNDKTDLNIARAEQHVSSRLDNTNTSSVVCDGNQPAARWIGAAKFRRNSPVDPVVSPHDRSPTFPWSATDDGVTCQPDRQVTAPELSKRVVEPGRARALVASWETREKALTADTPVLVSGRPPTSPGVDMNSFIPRGSHGTSESDLTVSDDNSAIEELMQQHNAFTSILQARLTKLQVIRRFWQRNDLKGAIDATGKMGDHSVSADVISVLIERSEIFTLDICTVILPLLTRLLQSETDRHLTVAMETLLVLVKTFGDVIRATISATPTIGVDLQAEQRLERCNLCYVELENIKQILVPLIRRGGAVAKSAQELSLALQEV

SEQ ID NO: 512 - protein, 434 aa, Eucalyptus sp.; identical to SEQ ID NO: 278

SEQ ID NO: 513 - protein, 266 aa, Eucalyptus sp.
MQAPREGKSAAAIVGMGKYMKKSKAIPRDVSLLEASPRSPSATGVRTRAKTLASRRLRRASQRRPPPPAAAAAAAAPSLDASPCPFSYLQLRSRRLRRPRLAPSPEARIDEGPAGSGSRGSRDASCSARTASSSGGVEGEGACVGRGDRGNGGECVRDAAVDASYGENDLEIEDRDRSTRESTPCSLIRDSNANTPPGSTTRQQSSCTAHRTQMSILRSIPTSDEMEEFFAYAEQRQQRSFIEKYNFDIVKDRPLPGRFEWVQVIP

SEQ ID NO: 514 - protein, 568 aa, Eucalyptus sp.
MDGHSSHLAAQNRSRGSQTPSPSHSAASASATSSIHLKRKLSAANASAASAAAAAAAAAAAADDHAPPFPPSSISADTRDGALTSNDDLESISARGGGAGDDSDDDSDDEEEDDGDNDGGSSLRTFTAARLENVGPAAARNRKIKAESNATVKVEKEDSAKDGGNGAGVGALGPAATSGAGSGSGTVPKEDAVKIFTENLQASGAYSAREENLKREEEAGRLKFECLSNDGVDDHMVWLIGLKNIFARQLPNMPKEYIVRLVMDRNHKSVMVIRRNLVVGGITYRPYASQKFGEIAFCAIKADEQVKGYGTRLMNHLKQHARDVDGLTHFLTYADNNAVGYFIKQGFTKEIYLDKDRWHGYIKDYDGGILMECKIDPKLPYTDLSTMVRRQRQAIDEKIRELSNCHIVYQGIDFQKRDAGVPQNTIKMEDIPGLREAGWTPDQWGYSRFRGLSDQKRLTFFIRQLLKVLNDHSDAWPFKEPVDAREVPDYYDIIKDPMDLKTMTKRVESEQYYVTLEMFIADVKRMFANARTYNSPDTIYFKIATRLEAHFQSKVQSNLQSGAGKIQQ

SEQ ID NO: 515 - protein, 585 aa, Eucalyptus sp.
MFNGMMDPELFKLAQEQMNRMSPAELAKIQQQMMSNPELMRMASESMKNMRPEDLRQAAEQLKHVRPEEMAEIGEKMANASPEEIAAVRARADAQMTYEINAAKILKKEGNELHSQGRFKDASQKYLRAKNNLKGIPSSEGKNLLLACSLNLMSCYLKTRQYEECIKEGSEALACEEKNLKAFYRRGQAYRELGQLKDAVSDLRKAHEISPDDETIAQVLRDTEESLTKEGGSAPRGVVIEEITEEDETLASVNHESPSEYSEKRHQESEDAHKGPINGDIMGQMTNSESLKALKGDPDAIRSFQNFISNADPTTLAAMGAGNAGEVSPDLIKTASSMIGKMSAEELQKMIQLASSFPGENPYVTRNSDSNSNSFGNGSIPNVSPDMLKTASDMMSKMSPDDLQRMFEMASSSRGKDPSLDANHASSSSGANLAANLNHILGESEPSSSYHIPSSSRNISSSPLSNFPSSPGDMQEQIRNQMKDPAMRQMFTSMMKNMSPEMMANMGKQFGLELSPEDAAKAQEAMSSLSPEMLDKMMRWADRAQRGVETAKKTKNWLLGRPGMILAICMLLLAVILHRLGFIGS

SEQ ID NO: 516 - protein, 498 aa, Eucalyptus sp.
MIAAISWVPRGASKAVPEVAEPPSKEEIEEILKSGVVERSGDSDGEEDDENMDAVASEKADEVSTALSAADALGRISKVTKAGSGFEDIADGLRELDMDNYDEEDEDVKLFSTGLGDLYYPSNDMDPYLKDKDDDDDTEEIEDLSIKPMDSLIVCARTDDEVNLLEVYLLEPSLSDESNMYVHHEVVISEFPLCTAWLDCPIKGGDKGNFIAVGSMEPAIEIWDLDIIDAVEPCLVLGGQEELKKKKKKGKKASIKYKEGSHTDSVLGLAWNKEFRNILASASADRQVKIWDVAAGKCNITMEHHTDKVQAVAWNHHAPQVLLSGSFDHSVVMKDGRIPSHSGYRWSVTADVESLAWDPHSEHFFVVSLEDGTVRGFDVRAAISNSASQSLPSFTLHAHEKAVSTISYNPAAPNLLATGSTDKMVKLWDLSNNQPSCIASRNPKAGAVFSVSFSEDSPLLLAIGGSKGRLEVWDTSSDAAVSRRFGKHGKPKTAEPGS

SEQ ID NO: 517 - protein, 328 aa, Eucalyptus sp.
MKFCKKYQEYMQGQEGKKLPGLGFKKLKKILKRCRRRDSLHSQKALQAVQNPRTCPAHCSVCDGSFFPSLLEEMSAVLGCFNKQAQKLLELHLASGFQKYLMWFKGKLRGNHVALIQEGKDLVTYALINAIAIRKILKKYDKIHLSTQGQAFKSQVQRMHMEILQSPWLCELIAFHINVRETKANSGKGHALFEGCSLVVDDGKPSLSCELFDSIKLDIDLTCSICLDTVFDSVSLTCGHIYCYMCACSAASVTIVDGLKAAEPKEKCPLCREARVFEGAVHLDELNILLSRSCPEYWAERLQTERVERVRQAKEHWESQCRAFMGVE

SEQ ID NO: 518 - protein, 926 aa, Eucalyptus sp.
MVSTQSTRENPSIFFPPPLKPWLLPVVLSLSLSRQLGMAAAAAASLPFKKNYRSSQALQQFYAGGPFAVSSDGSFIACNCGDSIKIVDSSNASLRPSIDCGSDTITALSLSPDGKLLFSAGHSRQIRVWDLSTSTCLRSWKGHDGPVMSMACPVSGGLLATGGADRKVMVWDVDGGFCTHFFKGHDGVVSTVLFHPDSNRSLLFSGSDDGTIRVWDLLAKKCASTLRGHDSTVTSLAFSEDGLTLLAAGRDKVVSLWDLHNYACKKTIPMYEVLESVCVIHSGTVLASQLGLDDQLKVTKESAQNIHFITVGERGILRIWKSEGSVCLFKQEHSDVTVISDEDDSRSGFTAAVMLPLDQGLLCVTADQQFLFYYPEKHPEGIFSLTLCRRLVGYNEEIVDMKFLGEEENFLAVATNLEQVRVYELASMSCSYVLAGHTETVLCLDTCISSSGRTLIVTGSKDNSVRLWDSESRHCIGVGVGHMGAVGAVAFSRKRQDFFVSGSSDRTLKVWSLDGISEDGVDSTNLKAKAVVAAHDKDINSVAVAPNDSLVCSGSQDRTACVWRLPDLVSVVVLKGHKRGIWSVEFSPVDQCVLTASGDKTVKIWAISDGSCLKTFEGHVSSVLRASFLTRGTQFVSCGADGLVKLWTVRTNECIATYDQHSDKVWALAVGKKTEMLATGGSDAVVNLWYDSTASDKEDAFRKEEEGVLKGQELENAVSDADYTKAIELALELRRPHKLFELFSELCRTREVGDRVERILSALSGEEVCLLLEYIREWNAKPKLCHVAQSVLSQVFRILSPTEIVEIKGIGELLEGLIPYSQRHFSRIDRLVRSTYLLDYTLTGMSVIEPEADRSAVNDGSPDKSGLEKLEDGLLGENVGEEKIQNKEELESSAYKKRKLPRSKDRSKKKSKNVVYADAAAISFRA

SEQ ID NO: 519 - protein, 476 aa, Eucalyptus sp.
MDSAPRRKSGGINLPSGMSETSLRLDGFSGSSSSFRAISNLTSPSKSSSISDRFIPCRSSSRLHTFGLVERGSPVKEGGNEAYSRLLKAELFGSDFGSLSPAGQGSPMSPSKNMLRFKTESSGPNSPFSPSILRQDSGFSSEASTPPKPPRKVPKTPHKVLDAPSLQDDFYLNLVDWSSQNTLAVGLGTCVYLWSASNSKVTKLCDLGPNDGVCAVQWTREGSYISIGTSLGQVQIWDGTQCKRVRTMGGHQTRTGVLAWNSRILASGSRDRVILQHDLRVPNEFIGKLVGHKSEVCGLKWSHDDRELASGGNDNQLLVWNQHSQQPVLKLTEHTAAVKAIAWSPHQNGLLASGGGTADRCIRFWNTTNGHQTSSVDTGSQVCNLAWSKNVNELVSTHGYSQNQIMVWKYPSMAKVATLTGHSLRVLYLAMSPDGQTIVTGAGDETLRFWNVFPSAKAPAPVKDTGLWSLGRTHIR

SEQ ID NO: 520 - protein, 669 aa, Eucalyptus sp.
MEDEAEIYDGVRAQFPLTFGKQSKPQTSLESVHSATRRGGPAPAPAPASSSSLPSTTSPSAAGGAGKSSGLPSLSSSSTAWLEGLRAGNPRAGREAGIGSRGGDGEDGGRAMIGPPRPPPGFSANDDGGGEDDDDDGDGVMVGPPPPPPGNLGDGDDDEEEEEAMIGPPRPPVVDSDEEEEEEEEENRYRLPLSNEIVLKGHNKIVSALAVDPTGSRVLSGSYDYTVRMFDFQGMNSRLSSFRDFEPVEGHQVRNLSWSPTADRFLCVTGSAQAKIYDRDGLTLGEFVKGDMYIRDLKNTKGHITGLTWGEWHPKTKETILTSSEDGSLRIWDVNDFKSQKQVIKPKLARPGRVPVTTCTWDREGKCIAGGIGDGSIQIWNLKPGWGSRPDIHVEQAHADDITGLKFSSDGKILLTRSFDDSLKVWDLRLMKNPLKVFEDLPNHYAQTNIACSPDEQLFLTGTSVERESTIGGLLCFFDRSKLELVSRIGISPTCSVVQCAWHPRLNQIFATSGDKSQGGTHVLYDPTLSERGALVCVARAPRKKSVDDFELKPVIHNPHALPLFRDQPSRKRQREKILKDPLKSHKPELPMNGPGHGGRVGASKGSLLTQYLLKQGGMIKETWMDEDPREAILKHADAAEKNPKFTRAYAETQPDPVFAKSDSEDEDK

SEQ ID NO: 521 - DNA, 60 bp, Eucalyptus sp.
gattttaagtaactcaattagcagttccaacattaaaccattattattaccccttttatc

SEQ ID NO: 522 - DNA, 60 bp, Eucalyptus sp.
ctcaaaaagtacttggatgcgtgcggtgacaacggactcgaaccgtacactgtcaaatct

SEQ ID NO: 523 - DNA, 60 bp, Eucalyptus sp.
ttgtcaagttgcaggacgtagtgcacagtgagaggcgtctatatctagtttttgagtact

SEQ ID NO: 524 - DNA, 60 bp, Eucalyptus sp.
gaagaaattatataactagatacaaggttagctaggtatataatagcggtacaagtcttt

SEQ ID NO: 525 - DNA, 60 bp, Eucalyptus sp.
ggacaaatcaagtagaacttctctcggcagcatcagtttttctaatccatgccttgttgc

SEQ ID NO: 526 - DNA, 60 bp, Eucalyptus sp.
ctcagttctgataatgcctcggatatatggccgagtgttcgctggacggcctcttatgtt

SEQ ID NO: 527 - DNA, 60 bp, Eucalyptus sp.
ggagattctgaactgcaacagctcctacacattttcagactgttgggtactccaaatgaa

SEQ ID NO: 528 - DNA, 60 bp, Eucalyptus sp.
gactggtaaaatcgttgcactaaaaaaggtccggtttgacaacttggaacctgaaagcgt

SEQ ID NO: 529 - DNA, 60 bp, Eucalyptus sp.
aaacaccaatctatcaacactgtcgagtttagtcactagtagaaccggagataacaaaca

SEQ ID NO: 530 - DNA, 60 bp, Eucalyptus sp.
ctatgatcctgagcgcaagcaagttatgaccaatagagtcgttacactatggtaccgagc

SEQ ID NO: 531 - DNA, 60 bp, Eucalyptus sp.
tgttgtgaaggtagttatagccatcgattagacagtgattaaagtagtacccgtgccaat

SEQ ID NO: 532 - DNA, 60 bp, Eucalyptus sp.
ccacatacaagagttgttacgctacacatcctataccatcaaaggaacgttggaatgcca

SEQ ID NO: 533 - DNA, 60 bp, Eucalyptus sp.
tatgatcgacacaagcattttgtgttggagcctcagctaattgtatgtcatcgagtactt

SEQ ID NO: 534 - DNA, 60 bp, Eucalyptus sp.
aaaatttttgctacggataatgttgtgaggcgaggcagtcgaaattacggaggttgactt

SEQ ID NO: 535 - DNA, 60 bp, Eucalyptus sp.
atgcagggatcaaatttgtgagtactacgtaaaattttgctacggaggcgaggcagtcga

SEQ ID NO: 536 - DNA, 60 bp, Eucalyptus sp.
gaagaatacaggctcgtacctgatacactgtacctgactgttaactacatagatcggtat

SEQ ID NO: 537 - DNA, 60 bp, Eucalyptus sp.
tccaccctaaatgcgatacgtgaaaagtatagacaacagaaggtaaactattcattactg

SEQ ID NO: 538 - DNA, 60 bp, Eucalyptus sp.
aggcttctagttgcgttcccccaaactacatggatcggcagcaggatattaatgagcgga

SEQ ID NO: 539 - DNA, 60 bp, Eucalyptus sp.
gagaaaaatgacagattgatatcgatgatgatgactgtcgtgtcatcagtagtgtgcttt

SEQ ID NO: 540 - DNA, 60 bp, Eucalyptus sp.
tttccaattgtagttcgtcttttattgtaacaataaattgatagatactgattcgaaata

SEQ ID NO: 541 - DNA, 60 bp, Eucalyptus sp.
acatttatgctaactataggagaacggagaattgtagctgcgtctctgctaactacatgg

SEQ ID NO: 542 - DNA, 60 bp, Eucalyptus sp.
ttctggcttaaaggctattctttgtgcacaatgacctgagggaggtctcgacagaccact

SEQ ID NO: 543 - DNA, 60 bp, Eucalyptus sp.
ttcatccgggtcctggttatcatactcttatatatgttggggaataacggttcatatgtt

SEQ ID NO: 544 - DNA, 60 bp, Eucalyptus sp.
gggtgtgcttaatagttcttattagtcttagcttattatctttgattggacatgctataa

SEQ ID NO: 545 - DNA, 60 bp, Eucalyptus sp.
cttgctaagtagacatgttatatttctaatgctttgagaacaatattacagtataattag

SEQ ID NO: 546 - DNA, 60 bp, Eucalyptus sp.
aatcatcgactagaccgatggtcaaagtggtaatcatgtaattaaacgcgtttgtcattg

SEQ ID NO: 547 - DNA, 60 bp, Eucalyptus sp.
atggaaaaatctatggatatgaaggattgaagatatccgtctgggtaagctgtgtatcat

SEQ ID NO: 548 - DNA, 60 bp, Eucalyptus sp.
ttatgatttgagaaaacccttgcaggctgcgatttgcggatcatgacagcatagttttgc

SEQ ID NO: 549 - DNA, 60 bp, Eucalyptus sp.
gttttgttgtgagggcttggtaggttttcattatattgtaatgtcgacgacagagatttt

SEQ ID NO: 550 - DNA, 60 bp, Eucalyptus sp.
ccaattaatgttactgctcaagctgacgtacctgcgaaaaaagcaccagtgactgctaat

SEQ ID NO: 551 - DNA, 60 bp, Eucalyptus sp.
tgatgtcaaaacgtagctcttttttgtgtgagctatcctgctaaattaaacctcagcaaa

SEQ ID NO: 552 - DNA, 60 bp, Eucalyptus sp.
acatgagtattatgaatacttcggtcctgactatacacttcatgttgctccgagtaacat

SEQ ID NO: 553 - DNA, 60 bp, Eucalyptus sp.
gaattggcgatcacaatctactgtagtcaatactcaagtgggaggtgtaaatagattcca

SEQ ID NO: 554 - DNA, 60 bp, Eucalyptus sp.
gatcatgtgtaatcagtatatcaggttagaaacagtactcttgagcttagcgggcactgt

SEQ ID NO: 555 - DNA, 60 bp, Eucalyptus sp.
tcctgtgaaggtggtcgactcaatcaaaaggtaccttgtagataaggtaccttttctcaa

SEQ ID NO: 556 - DNA, 60 bp, Eucalyptus sp.
gcattttatacgacggatagagtcatgaccgtatctttccataagtttggggacttcttc

SEQ ID NO: 557 - DNA, 60 bp, Eucalyptus sp.
cctcgtttctttgcggttcggacgcatcatggatgtatctccaaagagtaatctgtcgat

SEQ ID NO: 558 - DNA, 60 bp, Eucalyptus sp.
aattcagatctattagtgaaagttggcatgagtctcaatcttaggggaatacagtacgga

SEQ ID NO: 559 - DNA, 60 bp, Eucalyptus sp.
tgatatgagtatcataactcggatggtgacaactttgtactacggtcggcaccggtagat

SEQ ID NO: 560 - DNA, 60 bp, Eucalyptus sp.
catatacaatcttagtggattagctgaggtcgaaactgacaagagtgatcgcccgttgga

SEQ ID NO: 561 - DNA, 60 bp, Eucalyptus sp.
catggctaacgctggccctagcactaatgggagccaatttttcatatgcactgtaaagac

SEQ ID NO: 562 - DNA, 60 bp, Eucalyptus sp.
aacaaagtctaccttgacattagcatcggtaaccctgtcgggaaactagtcggaagaatt

SEQ ID NO: 563 - DNA, 60 bp, Eucalyptus sp.
tgtgcttggatatactgtataagcattctatattatgcttgttggcttcgttttgaggga

SEQ ID NO: 564 - DNA, 60 bp, Eucalyptus sp.
ttaacgtcgaccgcttctctgccccttgaattttcccgagaaaaccaggaacctgccaaa

SEQ ID NO: 565 - DNA, 60 bp, Eucalyptus sp.
tgttgaatacgatgtattataatgttggtgtcttggtgaaatacagaattatgcttgcgt

SEQ ID NO: 566 - DNA, 60 bp, Eucalyptus sp.
atcgctgtggctgatctcgtcgctccggcttttcataaaaatcatggctgaggcaatcga

SEQ ID NO: 567 - DNA, 60 bp, Eucalyptus sp.
ctcgcaaccctatatctcgctcaggcgaagaagtctgaggatttgaaagaggtgactcac

SEQ ID NO: 568 - DNA, 60 bp, Eucalyptus sp.
tgtttttgggtacacgcagttaggataactagcatgaaagcccgatcccgcatatacagg

SEQ ID NO: 569 - DNA, 60 bp, Eucalyptus sp.
gaggactagccggaacttcatcgaactctctcggaggggttactacgataacgtcaagtt

SEQ ID NO: 570 - DNA, 60 bp, Eucalyptus sp.
gatggctagcactgtgtagaaaggtgaatttaaagtacttgtctacactgcttattaaat

SEQ ID NO: 571 - DNA, 60 bp, Eucalyptus sp.
tgagactgtcttggcgtgtattttggaataaactattatcacgttttgttaaatataata

SEQ ID NO: 572 - DNA, 60 bp, Eucalyptus sp.
ttacaaaatggctctcagaaagtatcgaaaggccctgcgctatctggatatctgctggga

SEQ ID NO: 573 - DNA, 60 bp, Eucalyptus sp.
aattttatgtttgctactgcttagtgcttaatggacttgcgtaggtattcaaattacaga

SEQ ID NO: 574 - DNA, 60 bp, Eucalyptus sp.
tggaaccgtggtatcggctgacgttatccgtgattttaagactggagatagtttatgcta

SEQ ID NO: 575 - DNA, 60 bp, Eucalyptus sp.
ctttgatgtatcctcagtgtactgcttttagctatgtatagatcgagtcaactcattgaa

SEQ ID NO: 576 - DNA, 60 bp, Eucalyptus sp.
tttttattatttaccttcgcctttacgctgcatacgttaataggttattatttccttcaa

SEQ ID NO: 577 - DNA, 60 bp, Eucalyptus sp.
atttgtccatgacaatcgtagtcgaagacacgatacgctcttagatggtacggaaatctg

SEQ ID NO: 578 - DNA, 60 bp, Eucalyptus sp.
tgaatagagataacttttctgagtgtgaattggatattacgttgcaaatagccgaatgaa

SEQ ID NO: 579 - DNA, 60 bp, Eucalyptus sp.
gctttaggttagggatccctgtaagctgatgatagatattggagatggtacttgtaagat

SEQ ID NO: 580 - DNA, 60 bp, Eucalyptus sp.
tgttgtgtttggaaaggtgctgtctgggatggatgttgtccacaagattgaggctgaagg

SEQ ID NO: 581 - DNA, 60 bp, Eucalyptus sp.
ggaaagcggggaatgagcatgtggatattatctctttctacaatgaaatattcattcctt

SEQ ID NO: 582 - DNA, 60 bp, Eucalyptus sp.
catcaggacgttgactctaattaagacatatgtgacagagcgccctgttaatgcggttac

SEQ ID NO: 583 - DNA, 60 bp, Eucalyptus sp.
ctttaggtttgatctgtctgttttgtctatcctgcgagtttcgagcatgtgcgtgtgtga

SEQ ID NO: 584 - DNA, 60 bp, Eucalyptus sp.
cagccccaatagatactggctctgtgccgctactgagaacagtattaaaatctgggacct

SEQ ID NO: 585 - DNA, 60 bp, Eucalyptus sp.
aagaatgaagctgatatgagtgatggaactacgggggccatgagctcaaataagaaggtc

SEQ ID NO: 586 - DNA, 60 bp, Eucalyptus sp.
tgactacaattagcacctcaccattatcgaactgtataattgtgcttgcctgctattatt

SEQ ID NO: 587 - DNA, 60 bp, Eucalyptus sp.
ttgaagcggaaatatatatttatgctactacataagtaatgtactacttgacaagatgag

SEQ ID NO: 588 - DNA, 60 bp, Eucalyptus sp.
tactcgatgtggtatagaatttatccaatgtactcctaaatgtagatacatcgtgtattg

SEQ ID NO: 589 - DNA, 60 bp, Eucalyptus sp.
gcttcgtctgataccactatcaagataataggcgtgagcaatagctctggatcacagcac

SEQ ID NO: 590 - DNA, 60 bp, Eucalyptus sp.
ggtcggcttgctagtgtatctgatgacaagagcatatcactctatgattactcatgaagg

SEQ ID NO: 591 - DNA, 60 bp, Eucalyptus sp.
gaaaggagaaaagcatggagatcgatctcggaaacctcgcattcgacgtcgattttcatc

SEQ ID NO: 592 - DNA, 60 bp, Eucalyptus sp.
gattcagtacccggattcgcaagtcaaccggttggagataactccacataagcggtacct

SEQ ID NO: 593 - DNA, 60 bp, Eucalyptus sp.
ttccatgtatcaagccgcatcaatgtttgtcgctgcaattaacatgtgtgcagtcgatcc

SEQ ID NO: 594 - DNA, 60 bp, Eucalyptus sp.
ttcagcgcattgtgtaaatgtagataggtgatatatttctcgttgcaatgtagggtaaga

SEQ ID NO: 595 - DNA, 60 bp, Eucalyptus sp.
tccaataatcacatttaccatcaacaggcatcagcaacatactgttgtagtgtaattaat

SEQ ID NO: 596 - DNA, 60 bp, Eucalyptus sp.
gggcattctgactacctgcactgtatagctgcacggaactcttctagtcagattataaca

SEQ ID NO: 597 - DNA, 60 bp, Eucalyptus sp.
aatcgtctggtagattgtcaaaaactaataaacctgtgattgatccggattctagtaatg

SEQ ID NO: 598 - DNA, 60 bp, Eucalyptus sp.
agttgaggattctccactatgacagctctcatggcttgaatctaaagtcatctggttttc

SEQ ID NO: 599 - DNA, 60 bp, Eucalyptus sp.
gaacaatcattctgtagaacactagagtctatatgcttgactgtatcggttaattaattc

SEQ ID NO: 600 - DNA, 60 bp, Eucalyptus sp.
agatagcgatagagttatactgcatgtactgaggtaaatgttttgattactccacccaat

SEQ ID NO: 601 - DNA, 60 bp, Eucalyptus sp.
aagaattgttaggaggtgtatactttctgtaactgtattcaatgagcatacacctgacgg

SEQ ID NO: 602 - DNA, 60 bp, Eucalyptus sp.
caactcatataatgactggattctggcaaccgcgtcttcagacacaacagttggactatt

SEQ ID NO: 603 - DNA, 60 bp, Eucalyptus sp.
agtgtaaaaggatgcccctaatagattatatgccaagtgtagtatatataatagtgcttt

SEQ ID NO: 604 - DNA, 60 bp, Eucalyptus sp.
aagaatctacagttgtcttatgctactctattactcaattatgctgtgctattgattgag

SEQ ID NO: 605 - DNA, 60 bp, Eucalyptus sp.
tctgaatacatactttgtggtctctataaaagaccaatgatacaggcatggtcattaatt

SEQ ID NO: 606 - DNA, 60 bp, Eucalyptus sp.
taaatcttctcatgtgcctggcgtaaattttgcagttattactagaccaagatagtttca

SEQ ID NO: 607 - DNA, 60 bp, Eucalyptus sp.
acatggattcgatcaatcgccacatgacaactaaaacaagcggttcacgtgattgtaatt

SEQ ID NO: 608 - DNA, 60 bp, Eucalyptus sp.
agatgagtatgctcgggtgtatgatattcgcaattacaagtggaatggatcgcataattt

SEQ ID NO: 609 - DNA, 60 bp, Eucalyptus sp.
tctttgattctgttgtatggtgtatcttattgtatcttctatctgccccccatgtaattc

SEQ ID NO: 610 - DNA, 60 bp, Eucalyptus sp.
ttcgttgtgtagtactgggagttactacttgtatgtatgtaaatcatgtggcgtctgtcc

SEQ ID NO: 611 - DNA, 60 bp, Eucalyptus sp.
ggagatgtgtaatatgtctgagcggtcacactctagctgttacatgcgtaaagtggggag

SEQ ID NO: 612 - DNA, 60 bp, Eucalyptus sp.
ccaccgttgcgtaactcgaatagccggattttcgttttcgtttttatttccccgttaatt

SEQ ID NO: 613 - DNA, 60 bp, Eucalyptus sp.
tgagatgctctgtgtgaggacttttacgaaacttgaatggcccgtaaggacaataagctt

SEQ ID NO: 614 - DNA, 60 bp, Eucalyptus sp.
tgggttgttgcgacgggttctacagataagactgttaagttatttgatctacgcaagatc

SEQ ID NO: 615 - DNA, 60 bp, Eucalyptus sp.
gcagaggtgcctacatatgctttagaatgctagtagcttggaagtgcaacacgctcgtga

SEQ ID NO: 616 - DNA, 60 bp, Eucalyptus sp.
agtaaagtttaacgactatgcatctgtcgtagtatcagccggctatgatcgttcagtgcg

SEQ ID NO: 617 - DNA, 60 bp, Eucalyptus sp.
cgttaggatagtctttaaaggagttggtgattattgatttccacccaatatatgtagcgt

SEQ ID NO: 618 - DNA, 60 bp, Eucalyptus sp.
gagcaagctacttacaaaaatcgacagcgtctttacctatctgaacagacagatggcagt

SEQ ID NO: 619 - DNA, 60 bp, Eucalyptus sp.
tccttccgacaagtaccgtattgcaagttgtggtatggacaatacggttaaaatctggtc

SEQ ID NO: 620 - DNA, 60 bp, Eucalyptus sp.
tttcactcgatgacggttggccggataaataatcgcttatatagtcctaataagttccat

SEQ ID NO: 621 - DNA, 60 bp, Eucalyptus sp.
atatgtaggtggtagaggtgtggatattgcatagaccgaacctccgcaggtccgcattct

SEQ ID NO: 622 - DNA, 60 bp, Eucalyptus sp.
ccattgaactacttatggattactttatacatgaaatatcatgccggagtaattttgagt

SEQ ID NO: 623 - DNA, 60 bp, Eucalyptus sp.
agcattagagacctggattttagtctagattcagagtttttggctacgacatctactgat

SEQ ID NO: 624 - DNA, 60 bp, Eucalyptus sp.
aaaggtttatccctcattggatttgatatataaactgagagtgttttgccccccattaaa

SEQ ID NO: 625 - DNA, 60 bp, Eucalyptus sp.
gtacagcgtgtatttcttgttacgatacttgaggggttagaggcacctacgaattaggaa

SEQ ID NO: 626 - DNA, 60 bp, Eucalyptus sp.
atatccttatgaatgaagtttggatgataagtggcgccagactttctactcacccttttt

SEQ ID NO: 627 - DNA, 60 bp, Eucalyptus sp.
tgatcacatcgttgtttgcaataagacgtcatcaatttatatcatgactctacagggaca

SEQ ID NO: 628 - DNA, 60 bp, Eucalyptus sp.
ttttcccagtgtactgcgagagtgatgctacataagtttactcttgtgtctaacttttcc

SEQ ID NO: 629 - DNA, 60 bp, Eucalyptus sp.
agattctacagatggcgctatacgagctgttatacggacattttatgaccatacacatcc

SEQ ID NO: 630 - DNA, 60 bp, Eucalyptus sp.
tgctacgggaaaccaggacaaaacttgtaggatttgggacatacgaaacttatctaagtc

SEQ ID NO: 631 - DNA, 60 bp, Eucalyptus sp.
caagtcatatagttacagtgtcgcatgacagaacaattaagctctggactagtaacgacg

SEQ ID NO: 632 - DNA, 60 bp, Eucalyptus sp.
tgccacatcgtaaccatcatagcacttatcatctaattatggtgaaagggagttatatat

SEQ ID NO: 633 - DNA, 60 bp, Eucalyptus sp.
gtttatacttataaacaacagagagacaactgtacaggtgttgtaaacactcccagtgtg

SEQ ID NO: 634 - DNA, 60 bp, Eucalyptus sp.
ctgtgttttagcccgagggccaatcacttagttgctacttcgtgggataatcaggtacgg

SEQ ID NO: 635 - DNA, 60 bp, Eucalyptus sp.
gcaaagtagagtttaagtttcgttgtgcttggaccggaaaactcacatgcttagagttta

SEQ ID NO: 636 - DNA, 60 bp, Eucalyptus sp.
aagatttgggcataacttgtatgaactttttctgttgtcgacactgtaattacacgagct

SEQ ID NO: 637 - DNA, 60 bp, Eucalyptus sp.
aaacagatgcatgtatgcttcataactctatagatatggaaatgtcactgtacactgatc

SEQ ID NO: 638 - DNA, 60 bp, Eucalyptus sp.
ttattggtgcacaggacggaaaattgcgcatatattctatttcaggtgatacattaacag

SEQ ID NO: 639 - DNA, 60 bp, Eucalyptus sp.
aggcacagacacttgcctaaaccaatatacaaggcaggtattctaaggcgcaccgtgaat

SEQ ID NO: 640 - DNA, 60 bp, Eucalyptus sp.
catgcgaaggtttctgggaattttcagtagaaaattcggtcgtggcggccatcctcgata

SEQ ID NO: 641 - DNA, 60 bp, Pinus radiata
ttaagctgatagctttagttcctacgtggaatgtataaatgcaccattgtccataaggca

SEQ ID NO: 642 - DNA, 60 bp, Pinus radiata
ggatgctctggttacatgactactccttagggaatcagtcagacattttaaataacttcc

SEQ ID NO: 643 - DNA, 60 bp, Pinus radiata
tcattaagcggtactggcagaggacatgtctatttatacaagcaaatggtcctattggct

SEQ ID NO: 644 - DNA, 60 bp, Pinus radiata
atgttggtcagacctcaaatattgtactccccacactagggagcatttacggtgaatata

SEQ ID NO: 645 - DNA, 60 bp, Pinus radiata
tcctctcgacccttagagtcctctgcgaatcttgttgttagttactgtgtacgctgtaac

SEQ ID NO: 646 - DNA, 60 bp, Pinus radiata
aagcatgttttgaatttatggtggtggcatgtggatatttgaacttggttgagaaaaatt

SEQ ID NO: 647 - DNA, 60 bp, Pinus radiata
cattcctattgaagggtcaacctttaattttggctagcaggactgtataggattatatgc

SEQ ID NO: 648 - DNA, 60 bp, Pinus radiata
ttattgtattttagattcttgatggccatctaaacttctggctgcttggtgcaacattga

SEQ ID NO: 649 - DNA, 60 bp, Pinus radiata
atagctaatgattccatgctatccatggtatctacttcacgataataaaggtcttagtcc

SEQ ID NO: 650 - DNA, 60 bp, Pinus radiata
cacctaataggcctgagtattgctcaccactatgctgatatggggagcaataacgttagt

SEQ ID NO: 651 - DNA, 60 bp, Pinus radiata
tttcttttcactttgtactaatgatcattgtgaccacaaaatctttatacacaatacaga

SEQ ID NO: 652 - DNA, 60 bp, Pinus radiata
cttgtcactatcctcatattgatatcacctcgtgtatgttgtggggtggcaaaattactt

SEQ ID NO: 653 - DNA, 60 bp, Pinus radiata
tattttaactcagcgacttaccagcctagtaagcaatggggagcttgcatgtattagttt

SEQ ID NO: 654 - DNA, 60 bp, Pinus radiata
attcgtcctggtcctttaggacatgtacttatgtccatgcaagtgcttcttgcctaagct

SEQ ID NO: 655 - DNA, 60 bp, Pinus radiata
ttctaggcgatatatatcgccgtaactttggatgtgttaagaatataggggatcattagc

SEQ ID NO: 656 - DNA, 60 bp, Pinus radiata
agttgcagagtgtgtagcaactgatgagcatagttgttatgtttctcaactcagttgcac

SEQ ID NO: 657 - DNA, 60 bp, Pinus radiata
aagaaactcatacactggacaggccaaccttccaaatatgtgtttagaaaacctttgtct

SEQ ID NO: 658 - DNA, 60 bp, Pinus radiata
aaggggtgctatccatatctagaatctaccatgctcaatgaggtatcttcattagtatac

SEQ ID NO: 659 - DNA, 60 bp, Pinus radiata
atctaatgctagtttattgatttctatgatccaagacctcgtcatagatcaagtgcctag

SEQ ID NO: 660 - DNA, 60 bp, Pinus radiata
ttgttattaaataccattcaatatgcttatgattcatgaatgcttaagagattctgctgc

SEQ ID NO: 661 - DNA, 60 bp, Pinus radiata
gcttctaaactgtagaagcctgttatctttagactcgtggttatgtgaactacttttaca

SEQ ID NO: 662 - DNA, 60 bp, Pinus radiata
ggctgtggggattcgagcctgatggttatgcactgtggccagcaagatgttgaagtttta

SEQ ID NO: 663 - DNA, 60 bp, Pinus radiata
gcctgatggttatgcactgtaagtgatctgatttgattaactattttatcaattaatttt

SEQ ID NO: 664 - DNA, 60 bp, Pinus radiata
atggtcattatccgagatagtgcgctttgtcatgggaaaatgactattgaatgtgagttt

SEQ ID NO: 665 - DNA, 60 bp, Pinus radiata
ttttctggtgcatccttaacacagcttggttacatggtgaattacagtatttgaaggagt

SEQ ID NO: 666 - DNA, 60 bp, Pinus radiata
agatttaatgccacttaggtgatcggtgacccacttgtacatatagatgttggcgatgtt

SEQ ID NO: 667 - DNA, 60 bp, Pinus radiata
aagaaattcatcaattctttgaaattattgttcccttttgatgcggcccctttctggagg

SEQ ID NO: 668 - DNA, 60 bp, Pinus radiata
taaagtatattttagccgctgttgttgtaaatttatgtttttcattgctatcaacattta

SEQ ID NO: 669 - DNA, 60 bp, Pinus radiata
ggttttcctataagatgtatgaattcgcactgtggtgcaattttatgaattaaactcaaa

SEQ ID NO: 670 - DNA, 60 bp, Pinus radiata
tttactattccgtctgggcttagagatgtacgttaattggtcatttaagacgactcagtt

SEQ ID NO: 671 - DNA, 60 bp, Pinus radiata
tcaaatctagtcaatatccgtgttgagctaaacaagcgctgaaagtttgctcgaatcagc

SEQ ID NO: 672 - DNA, 60 bp, Pinus radiata
agaaagttgtgtactaatttgtattgtaacgtccatttatccaacgagtcctccattcat

SEQ ID NO: 673 - DNA, 60 bp, Pinus radiata
cagtactgtattcgaagatcctgaaaatttactaaaacaaatggaatatcaacaacctag

SEQ ID NO: 674 - DNA, 60 bp, Pinus radiata
ttgctctatataatttgtgctcgtgtgtgtacttgaagatccatcctcacatagtccaat

SEQ ID NO: 675 - DNA, 60 bp, Pinus radiata
gtgtgtatagttttataacactctatggtatcactaccactatgggcctgtttagtccaa

SEQ ID NO: 676 - DNA, 60 bp, Pinus radiata
gaagcagaatcagctttgaccagtatttagtgtcttgtatacaattcttgtttcagtgaa

SEQ ID NO: 677 - DNA, 60 bp, Pinus radiata
aaatcaagattaaaatccgaaaccaaggctaaccagcaaactgtgaggtgtacattgttg

SEQ ID NO: 678 - DNA, 60 bp, Pinus radiata
ttccaagcagaagggcacatgttgtgacatcaagtagtagattgttctgcagattctggt

SEQ ID NO: 679 - DNA, 60 bp, Pinus radiata
gttaatgtaatacatttagtttttagataactgttaatgtgtagtaaagcactaggaaga

SEQ ID NO: 680 - DNA, 60 bp, Pinus radiata
gaggcttcaaaggtttttgtgtcttttctagttattataaacgcttcataggttcctagg

SEQ ID NO: 681 - DNA, 60 bp, Pinus radiata
gaagattgtaagttgggtgaacttttttaccacgctaggttgatctattttaagactctt

SEQ ID NO: 682 - DNA, 60 bp, Pinus radiata
aaaatagctgcgcgtaccacaaaggtgacaaacgccggatttctcttatcagacttgtca

SEQ ID NO: 683 - DNA, 60 bp, Pinus radiata
tttaattatcatagttttattccggctatcttgatcattcacggaagtcccgagagtcaa

SEQ ID NO: 684 - DNA, 60 bp, Pinus radiata
gtggagtgaacgtggttacttcaatggattacccttctatcgtgtcattaaacactttgt

SEQ ID NO: 685 - DNA, 60 bp, Pinus radiata
gctaactcttctagttgagatctccatcaattaatggatacaaacattgagtttcacttt

SEQ ID NO: 686 - DNA, 60 bp, Pinus radiata
ggatcactactggattccgttacattagttattgcaagttggttattatgtacgtttata

SEQ ID NO: 687 - DNA, 60 bp, Pinus radiata
atgaacaaatgcaattaccctgttttattctatcccgctttaattaatattggtcatgtt

SEQ ID NO: 688 - DNA, 60 bp, Pinus radiata
tttgcttgtggattgtactgtggtacatggtataaatctataggctatgtcgattatttt

SEQ ID NO: 689 - DNA, 60 bp, Pinus radiata
atataagatataagatattgccagcaaactatttgacaggttatttaataaagtgtgcta

SEQ ID NO: 690 - DNA, 60 bp, Pinus radiata
ttttaaatgtggacagaggcactataagaatgcgaaatatcgtcggagcacgactaattg

SEQ ID NO: 691 - DNA, 60 bp, Pinus radiata
atagactagttctacaaagccctaggatgatggacttcatttcttttgcattaagatgaa

SEQ ID NO: 692 - DNA, 60 bp, Pinus radiata
gatttcttatggggttggaacattcctcgctgccttctggtaatattaggttatgcgttt

SEQ ID NO: 693 - DNA, 60 bp, Pinus radiata
aattgaggttgactgtgtacttctccagtggacaggagaaagcgataaaattcaaacgtt

SEQ ID NO: 694 - DNA, 60 bp, Pinus radiata
aaggaagggcaaatagagctcgcgctcaagaaataccttaaatcgatacggtatttggat

SEQ ID NO: 695 - DNA, 60 bp, Pinus radiata
taatttaagagctatgaaacaactaccttttggaatggttttgtttttagcatcccaatt

SEQ ID NO: 696 - DNA, 60 bp, Pinus radiata
ttgtaaattatgctggttccatatgggggttaatcagtatcctggttatttgtgacacca

SEQ ID NO: 697 - DNA, 60 bp, Pinus radiata
gttgtgaactatcaatagacggggatggtcctttttagctgctccttaagcagctcaaat

SEQ ID NO: 698 - DNA, 60 bp, Pinus radiata
tcaattccggtcatatgtagacgactataatgttgtttgtgtcctataactatagtgttg

SEQ ID NO: 699 - DNA, 60 bp, Pinus radiata
cattttacaccctataacaaaatatagtgtcataagtttacaccaggtaacaactctata

SEQ ID NO: 700 - DNA, 60 bp, Pinus radiata
atggagagttttattcattacatgaaagagtatgtcacctttcgtgctccatctattgat

SEQ ID NO: 701 - DNA, 60 bp, Pinus radiata
tttcacgtcctgtatactcactcaagcaactttaggatgaagagctaaagtatatcaaag

SEQ ID NO: 702 - DNA, 60 bp, Pinus radiata
aatgcactctttataaagtgggatgaggtatgtgtttccttcctattggctaacctgaat

SEQ ID NO: 703 - DNA, 60 bp, Pinus radiata
attgggcaatcgttattgattttacctatcgctatctcactgtccgccaatttagtgtaa

SEQ ID NO: 704 - DNA, 60 bp, Pinus radiata
tttcagcggatataaagtcttccaacttgtaaaccggtgctgtgaagattaaaagtcctt

SEQ ID NO: 705 - DNA, 60 bp, Pinus radiata
gctttagaggcaatggtagattatgaagtcaacaccagggagtttgaccgtttgggacat

SEQ ID NO: 706 - DNA, 60 bp, Pinus radiata
cattcaatttgacattggagtttcaaggcattccaaggatagcatgtacacaagttgaat

SEQ ID NO: 707 - DNA, 60 bp, Pinus radiata
cataaaattactatggaagttggatcattatctatgccatagtggagtagaactagattt

SEQ ID NO: 708 - DNA, 60 bp, Pinus radiata
ctcttgattctagaatctaaactactaccttgcggacatgactgagcatctctctaacag

SEQ ID NO: 709 - DNA, 60 bp, Pinus radiata
cagggttgtgctagtttaacattttaacttaatgtaatcatgtaagctttagagaggtgg

SEQ ID NO: 710 - DNA, 60 bp, Pinus radiata
gtaaatgtttacattgaggtcatgcatgagtgttaattacgctttcactactgttcactt

SEQ ID NO: 711 - DNA, 60 bp, Pinus radiata
aattaaagcttggttgtatgatcatttgggatcgagagtagattatgatgctcctgggca

SEQ ID NO: 712 - DNA, 60 bp, Pinus radiata
ttatctagctagaagttgtgaaattaagagggatgtgaggattgggttataactagtgta

SEQ ID NO: 713 - DNA, 60 bp, Pinus radiata
aatgaatcaggcattaaagcgggaatcatttatgacttggcaacctgaaaattctattaa

SEQ ID NO: 714 - DNA, 60 bp, Pinus radiata
ttcttgacgttttaatatggtatggtattaaatttggaaggcctattcgattgtttgcaa

SEQ ID NO: 715 - DNA, 60 bp, Pinus radiata
ttcttataacctgtacgattgccgatatatcaccaattttgctgattttaatctgagttt

SEQ ID NO: 716 - DNA, 60 bp, Pinus radiata
caatttcatattcgggttcaatgtagtgcctctcattttagggtgatagcatgagttttt

SEQ ID NO: 717 - DNA, 60 bp, Pinus radiata
tccacaagttaacataggtaactatcgactgaagtgaactggggggcagaagctaactat

SEQ ID NO: 718 - DNA, 60 bp, Pinus radiata
tttagatagccatttacattttacttattattggacttgtaaagatttttgtacccttgt

SEQ ID NO: 719 - DNA, 60 bp, Pinus radiata
ttgctgaaatatttcaagctgaaagttatgattctggccaagaagtctactgaaaatttg

SEQ ID NO: 720 - DNA, 60 bp, Pinus radiata
aaacataagtttggcccagattcggtttatcataaaatctggctgcatataaggtgtcag

SEQ ID NO: 721 - DNA, 60 bp, Pinus radiata
atgttctagaatttgtctaagctagctactggtgtttaactgatatggaaaacttttgcc

SEQ ID NO: 722 - DNA, 60 bp, Pinus radiata
tttggggagtactttagtcaataaaagtgaagtgaatcatgatataaagggtttaagtaa

SEQ ID NO: 723 - DNA, 60 bp, Pinus radiata
agaagttactaatttgtagataaattctaacgaaggtgatgatagcatacacgtaatgaa

SEQ ID NO: 724 - DNA, 60 bp, Pinus radiata
gaattttgatggtagcgtatggttgaaggaaaacttggatatatcatgtaaacatttttc

SEQ ID NO: 725 - DNA, 60 bp, Pinus radiata
ttaatgaaccgctttttccttgagaggctatgaatgcctgtagaactaatcctttaagta

SEQ ID NO: 726 - DNA, 60 bp, Pinus radiata
tttctctaacactatattttctggtatgaccgctctacattgtatattaacccttgcaaa

SEQ ID NO: 727 - DNA, 60 bp, Pinus radiata
tatattcactgtgctgggattatcctctcccctttttgacccactgttgtgtgtatttga

SEQ ID NO: 728 - DNA, 60 bp, Pinus radiata
gagcatacagcgttatctttgagacgagtcatcaatgataatatcctcgtaaaaggttac

SEQ ID NO: 729 - DNA, 60 bp, Pinus radiata
tttattcaattacgacggattcagttggccttttgtaacattcaagtatccatctatcac

SEQ ID NO: 730 - DNA, 60 bp, Pinus radiata
atgttcaggggtattaaaaattcagaggataaatttcctcactctcaagtgttagatggt

SEQ ID NO: 731 - DNA, 60 bp, Pinus radiata
caaagtctagacgttaatgttttggaactcttttttcgaatttgtgcctattgaatcact

SEQ ID NO: 732 - DNA, 60 bp, Pinus radiata
tataaatatattgtactggggatccaagacatggcaatatatgtcgagattttcattttc

SEQ ID NO: 733 - DNA, 60 bp, Pinus radiata
cttttgcatgagttcaaatgtctttgtgacatattgtcttgaaccaccgaggatatatca

SEQ ID NO: 734 - DNA, 60 bp, Pinus radiata
gtttgtatgtccaatagattataacctatttactgtgacactattcttcacacccatgtc

SEQ ID NO: 735 - DNA, 60 bp, Pinus radiata
agatctagttgtttcagcatcgttggaccaaactgttcgtgtatgggatataagtggcct

SEQ ID NO: 736 - DNA, 60 bp, Pinus radiata
tgccgtatcaaaagattggtacttccttatggacacacaagatcgtaagcatggctgaat

SEQ ID NO: 737 - DNA, 60 bp, Pinus radiata
ttgatggccacatgagttgtttatacaagtcgttgttttatgagagaaccttcttcagat

SEQ ID NO: 738 - DNA, 60 bp, Pinus radiata
atttctatagtgccatatgcttgtcggttgtcattgacctctaatagaatagccagagta

SEQ ID NO: 739 - DNA, 60 bp, Pinus radiata
ttcacggcagttgaactagtcatagtggaatattatttaaatggtgtattctagtcacat

SEQ ID NO: 740 - DNA, 60 bp, Pinus radiata
tgcaggcgctctatagttctgttctctagcatgaagtgtgtattttatctattgtggacc

SEQ ID NO: 741 - DNA, 60 bp, Pinus radiata
tgtctttaatcttcagggttcgttactaacaattgagctcaaatctctattctgaccagc

SEQ ID NO: 742 - DNA, 60 bp, Pinus radiata
catttatagagttgtgcaaaatcacccataatgctatgaattgacaggtgactgtaatct

SEQ ID NO: 743 - DNA, 60 bp, Pinus radiata
ggagaaaatttcctatccctttgtgggtgtgtgaaaaacgaaatatagaggaacaatgtg

SEQ ID NO: 744 - DNA, 60 bp, Pinus radiata
accaatcatttatttgcagtgtagttgatatgaagggagaaatatgacagttggtttcaa

SEQ ID NO: 745 - DNA, 60 bp, Pinus radiata
aagttaatgttctcataggttattcattggagttgtctcgtatgtacgctgtgccgtagt

SEQ ID NO: 746 - DNA, 60 bp, Pinus radiata
ctcataaattgaggcttgcctacgttaattgttatatatggagagccatgctaattgtta

SEQ ID NO: 747 - DNA, 60 bp, Eucalyptus sp.
gcagatcatgtaattgtatctcaaattatagtatccgtattctgtacaaatgctccggaa

SEQ ID NO: 748 - DNA, 60 bp, Eucalyptus sp.
tctttacgcagatggtgactgaagctggttccgagatcggcatatgtagctggtagaggt

SEQ ID NO: 749 - DNA, 60 bp, Pinus radiata
ttcacattgagggttgccgtcggtattcgccgatgatatcctgttttacgcgcaacagtt

SEQ ID NO: 750 - DNA, 60 bp, Pinus radiata
tcattatttagggtgcaggctgtataaaatgttgtaaattgtagtatcaatgtgtacaat

SEQ ID NO: 751 - DNA, 60 bp, Pinus radiata
gcattcaccacgacagtaaagtaatcattatgattactaatgtattgctttcatggggtg

SEQ ID NO: 752 - DNA, 60 bp, Pinus radiata
aaagggtatattttgtctcatgttggggtgataattctccctgaaagtctccaaaatata

SEQ ID NO: 753 - DNA, 60 bp, Pinus radiata
aaatttccggttgccatagtctagtggggtgagggttcattctaggggatttattgtgtt

SEQ ID NO: 754 - DNA, 60 bp, Pinus radiata
gcagtgataaaggtacttcttggtgataatcctaaagccttacccatggatatccagcct

SEQ ID NO: 755 - DNA, 60 bp, Pinus radiata
ttctttaacaaggtaaaaatcccccccttggcatgtagctcaattagttgtaatggaact

SEQ ID NO: 756 - DNA, 60 bp, Pinus radiata
agttgtaaacagtgtaataaggagcagaagttgtgatagcttttaggaacgatagacttt

SEQ ID NO: 757 - DNA, 60 bp, Pinus radiata
tgaaccaattcttgtatattagatatgtaacatgtatgaatgtccatagagcagagcttt

SEQ ID NO: 758 - DNA, 60 bp, Pinus radiata
agccaggcacgcttaactaaatttcgtttagttcaccatgactattcgttgaacttaatg

SEQ ID NO: 759 - DNA, 60 bp, Pinus radiata
caaaaccccttgtagggtggacttctgttgtatccaatttttatggcataattagctagt

SEQ ID NO: 760 - DNA, 60 bp, Pinus radiata
aatttggtgattattccttaccatatcgtactgtacagatacggtaaggtcgaaatatat

SEQ ID NO: 761 - DNA, 60 bp, Pinus radiata
catgccgtgatcggtcgattgcattaagtgctgcaaggatcaaatagtggcactgtcatg

SEQ ID NO: 762 - DNA, 60 bp, Pinus radiata
caaacataaataaggttgctactttaaagggacatacggaacgagttactgatgtggcat

SEQ ID NO: 763 - DNA, 60 bp, Pinus radiata
atttatggatgaggtactccttatgaatatcttcaaactaagaaataactatatatgcaa

SEQ ID NO: 764 - DNA, 60 bp, Eucalyptus sp.
cttggtttttgttgagctttctatttcaagcaatttgtgattggggggttctgcattctt

SEQ ID NO: 765 - DNA, 60 bp, Eucalyptus sp.
atgtctaaagagccgtgatctatgagtagattagaaaccgcctttttagttgcaaacgcc

SEQ ID NO: 766 - DNA, 60 bp, Eucalyptus sp.
ttgcaacaaggtatacttagtcagtccttgttatgtatgtcttttgtcaacccttcaggg

SEQ ID NO: 767 - DNA, 60 bp, Eucalyptus sp.
ggcggaatccctttgttctttcgagctttacgtgacaagtcggccagaaagcagtagcat

SEQ ID NO: 768 - DNA, 60 bp, Eucalyptus sp.
ttgatgtacgagccgctatatctaattctgcctcccagtcactgccaagttttactcttc

SEQ ID NO: 769 - DNA, 60 bp, Eucalyptus sp.
gtcttgcatgtcagctattatacagtcctgtttatagtcctgtgatgtaataaaaagctg

SEQ ID NO: 770 - DNA, 60 bp, Eucalyptus sp.
aagtaggagatcgtgtagagagaatactttctgctctcagcggcgaagaggtttgtctgc

SEQ ID NO: 771 - DNA, 60 bp, Eucalyptus sp.
aattgtgagtagaataggagaaacttttgtacaagattaatacgtgtggcataataagat

SEQ ID NO: 772 - DNA, 60 bp, Eucalyptus sp.
tgatgtgcagtttacattattatggttcgagtattatttagctgccctatcttaagtcat

SEQ ID NO: 773 - DNA, 3448 bp, Artificial Sequence
  Description of Artificial Sequence: Synthetic vector
cgatgggtgttatttgtggataataaattcgggtgatgttcagtgtttgtcgtatttctcacgaataaattgtgtttatgtatgtgttagtgttgtttgtctgtttcagaccctcttatgttatatttttcttttcgtcggtcagttgaagccaatactggtgtcctggccggcactgcaataccatttcgtttaatataaagactctgttatccgtgagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgcggccgcatttaaatggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggggccgctctagaactagtggatcccccgggctgcaggaattcgtccagcagttgtctggagctccaccagaaatctggaagcttat

SEQ ID NO: 774 - DNA, 53 bp, Artificial Sequence
  Description of Artificial Sequence: Synthetic primer
aaatctagaggtaccatttaaatgcggccgcaaaacccctcacaaatacataa

SEQ ID NO: 775 - DNA, 36 bp, Artificial Sequence
  Description of Artificial Sequence: Synthetic primer
tttctgcagcttgaaattgaaatatgactaacgaat

SEQ ID NO: 776 - DNA, 5534 bp, Artificial Sequence
  Description of Artificial Sequence: Synthetic vector
tctagaggtaccatttaaatgcggccgcaaaacccctcacaaatacataaaaaaaattctttatttaattatcaaactctccactacctttcccaccaaccgttacaatcctgaatgttggaaaaaactaactacattgatataaaaaaactacattacttcctaaatcatatcaaaattgtataaatatatccactcaaaggagtctagaagatccacttggacaaattgcccatagttggaaagatgttcaccaagtcaacaagatttatcaatggaaaaatccatctaccaaacttactttcaagaaaatccaaggattatagagtaaaaaatctatgtattattaagtcaaaaagaaaaccaaagtgaacaaatattgatgtacaagtttgagaggataagacattggaatcgtctaaccaggaggcggaggaattccctagacagttaaaagtggccggaatcccggtaaaaaagattaaaatttttttgtagagggagtgcttgaatcatgttttttatgatggaaatagattcagcaccatcaaaaacattcaggacacctaaaattttgaagtttaacaaaaataacttggatctacaaaaatccgtatcggattttctctaaatataactagaattttcataactttcaaagcaactcctcccctaaccgtaaaacttttcctacttcaccgttaattacattccttaagagtagataaagaaataaagtaaataaaagtattcacaaaccaacaatttatttcttttatttacttaaaaaaacaaaaagtttatttattttacttaaatggcataatgacatatcggagatccctcgaacgagaatcttttatctccctggttttgtattaaaaagtaatttattgtggggtccacgcggagttggaatcctacagacgcgctttacatacgtctcgagaagcgtgacggatgtgcgaccggatgaccctgtataacccaccgacacagccagcgcacagtatacacgtgtcatttctctattggaaaatgtcgttgttatccccgctggtacgcaaccaccgatggtgacaggtcgtctgttgtcgtgtcgcgtagcgggagaagggtctcatccaacgctattaaatactcgccttcaccgcgttacttctcatcttttctcttgcgttgtataatcagtgcgatattctcagagagcttttcattcaaaggtatggagttttgaagggctttactcttaacatttgtttttctttgtaaattgttaatggtggtttctgtgggggaagaatcttttgccaggtccttttgggtttcgcatgtttatttgggttatttttctcgactatggctgacattactagggctttcgtgctttcatctgtgttttcttcccttaataggtctgtctctctggaatatttaattttcgtatgtaagttatgagtagtcgctgtttgtaataggctcttgtctgtaaaggtttcagcaggtgtttgcgttttattgcgtcatgtgtttcagaaggcctttgcagattattgcgttgtactttaatattttgtctccaaccttgttatagtttccctcctttgatctcacaggaaccctttcttctttgagcattttcttgtggcgttctgtagtaatattttaattttgggcccgggttctgagggtaggtgattattcacagtgatgtgctttccctataaggtcctctatgtgtaagctgttagggtttgtgcgttactattgacatgtcacatgtcacatattttcttcctcttatccttcgaactgatggttctttttctaattcgtggattgctggtgccatattttatttctattgcaactgtattttagggtgtctctttctttttgatttcttgttaatatttgtgttcaggttgtaactatgggttgctagggtgtctgccctcttcttttgtgcttctttcgcagaatctgtccgttggtctgtatttgggtgatgaattatttattccttgaagtatctgtctaattagcttgtgatgatgtgcaggtatattcgttagtcatatttcaatttcaagcgatcccccgggctgcaggaattcgtccagcagttgtctggagctccaccagaaatctggaagcttatcgatgggtgttatttgtggataataaattcgggtgatgttcagtgtttgtcgtatttctcacgaataaattgtgtttatgtatgtgttagtgttgtttgtctgtttcagaccctcttatgttatatttttcttttcgtcggtcagttgaagccaatactggtgtcctggccggcactgcaataccatttcgtttaatataaagactctgttatccgtgagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgcggccgcatttaaatggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggggccgctctag

SEQ ID NO: 777 - DNA, 7160 bp, Artificial Sequence
  Description of Artificial Sequence: Synthetic vector
tctagaggtaccatttaaatgcggccgcaaaacccctcacaaatacataaaaaaaattctttatttaattatcaaactctccactacctttcccaccaaccgttacaatcctgaatgttggaaaaaactaactacattgatataaaaaaactacattacttcctaaatcatatcaaaattgtataaatatatccactcaaaggagtctagaagatccacttggacaaattgcccatagttggaaagatgttcaccaagtcaacaagatttatcaatggaaaaatccatctaccaaacttactttcaagaaaatccaaggattatagagtaaaaaatctatgtattattaagtcaaaaagaaaaccaaagtgaacaaatattgatgtacaagtttgagaggataagacattggaatcgtctaaccaggaggcggaggaattccctagacagttaaaagtggccggaatcccggtaaaaaagattaaaatttttttgtagagggagtgcttgaatcatgttttttatgatggaaatagattcagcaccatcaaaaacattcaggacacctaaaattttgaagtttaacaaaaataacttggatctacaaaaatccgtatcggattttctctaaatataactagaattttcataactttcaaagcaactcctcccctaaccgtaaaacttttcctacttcaccgttaattacattccttaagagtagataaagaaataaagtaaataaaagtattcacaaaccaacaatttatttcttttatttacttaaaaaaacaaaaagtttatttattttacttaaatggcataatgacatatcggagatccctcgaacgagaatcttttatctccctggttttgtattaaaaagtaatttattgtggggtccacgcggagttggaatcctacagacgcgctttacatacgtctcgagaagcgtgacggatgtgcgaccggatgaccctgtataacccaccgacacagccagcgcacagtatacacgtgtcatttctctattggaaaatgtcgttgttatccccgctggtacgcaaccaccgatggtgacaggtcgtctgttgtcgtgtcgcgtagcgggagaagggtctcatccaacgctattaaatactcgccttcaccgcgttacttctcatcttttctcttgcgttgtataatcagtgcgatattctcagagagcttttcattcaaaggtatggagttttgaagggctttactcttaacatttgtttttctttgtaaattgttaatggtggtttctgtgggggaagaatcttttgccaggtccttttgggtttcgcatgtttatttgggttatttttctcgactatggctgacattactagggctttcgtgctttcatctgtgttttcttcccttaataggtctgtctctctggaatatttaattttcgtatgtaagttatgagtagtcgctgtttgtaataggctcttgtctgtaaaggtttcagcaggtgtttgcgttttattgcgtcatgtgtttcagaaggcctttgcagattattgcgttgtactttaatattttgtctccaaccttgttatagtttccctcctttgatctcacaggaaccctttcttctttgagcattttcttgtggcgttctgtagtaatattttaattttgggcccgggttctgagggtaggtgattattcacagtgatgtgctttccctataaggtcctctatgtgtaagctgttagggtttgtgcgttactattgacatgtcacatgtcacatattttcttcctcttatccttcgaactgatggttctttttctaattcgtggattgctggtgccatattttatttctattgcaactgtattttagggtgtctctttctttttgatttcttgttaatatttgtgttcaggttgtaactatgggttgctagggtgtctgccctcttcttttgtgcttctttcgcagaatctgtccgttggtctgtatttgggtgatgaattatttattccttgaagtatctgtctaattagcttgtgatgatgtgcaggtatattcgttagtcatatttcaatttcaagcgatcccccgggctgcaggaattcgtccagcagttgtctggagctccaccagaaatctggaagcttatcgatatggatcagttccccaagtggaatcctgtcaatagagaaacgtatatcgaaaggctgtcggcaaggtatgaaagagagggtgagccttctcagcttgctggtgtggattttttcgtgagtactgttgatccgctgaaggaaccgccattgatcactgccaatacagtcctttccatccttgctgtggactatcccgtcgataaagtctcctgctacgtgtctgatgatggtgcagctatgctttcatttgaatctcttgtagaaacagctgagtttgcaaggaagtgggttccgttctgcaaaaaattctcaattgaaccaagagcaccggagttttacttctcacagaaaattgattacttgaaagacaaggttcaaccttctttcgtgaaagaacgtagagcaatgaaaagggattatgaagagtacaaagtccgagttaatgccctggtagcaaaggctcagaaaacacctgaagaaggatggactatgcaagatggaacaccttggcctgggaataacacacgtgatcaccctggcatgattcaggtcttccttggaaatactggagctcgtgacattgaaggaaatgaactacctcgtctagtatatgtctccagggagaagagacctggctaccagcaccacaaaaaggctggtgcagaaaatgctctggtgagagtgtctgcagtactcacaaatgctccctacatcctcaatgttgattgtgatcactatgtaaacaatagcaaggctgttcgagaggcaatgtgcatcctgatggacccacaagtaggtcgagatgtatgctatgtgcagttccctcagaggtttgatggcatagataagagtgatcgctacgccaatcgtaacgtagttttctttgatgttaacatgaaagggttggatggcattcaaggaccagtatacgtaggaactggttgtgttttcaacaggcaagcactttacggctacgggcctccttctatgcccagcttacgcaagagaaaggattcttcatcctgcttctcatgttgctgcccctcaaagaagaagcctgctcaagatccagctgaggtatacagagatgcaaaaagagaggatctcaatgctgccatatttaatcttacagagattgataattatgacgagcatgaaaggtcaatgctgatctcccagttgagctttgagaaaacttttggcttatcttctgtcttcattgagtctacactaatggagaatggaggagtacccgagtctgccaactcaccaacactcatcaaggaagcaattcatgtcatcggctgtggctatgaagagaagactgaatggggaaaagagattggttggatatatgggtcagtcactgaggatatcttaagtggcttcaagatgcactgccgaggatggagatcaatttactgcatgcccgtaaggcctgcattcaaaggatctgcacccatcaacctgtctgatagattgcaccaggtcctccgatgggctcttggttctgtggaaattttctttagcagacactgtcccctctggtacgggtttggaggaggccgtcttaaatggctccaaaggcttgcgtatataaacaccattgtgtacccatgaatcgatgggtgttatttgtggataataaattcgggtgatgttcagtgtttgtcgtatttctcacgaataaattgtgtttatgtatgtgttagtgttgtttgtctgtttcagaccctcttatgttatatttttcttttcgtcggtcagttgaagccaatactggtgtcctggccggcactgcaataccatttcgtttaatataaagactctgttatccgtgagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgcggccgcatttaaatggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggggccgctctag

SEQ ID NO: 778 - protein, 7 aa, Unknown Organism
  Description of Unknown Organism: Cyclin binding consensus sequence
PSTAIRE

SEQ ID NO: 779 - protein, 7 aa, Unknown Organism
  Description of Unknown Organism: Cyclin binding consensus sequence
PPTTLRE

SEQ ID NO: 780 - protein, 7 aa, Unknown Organism
  Description of Unknown Organism: Cyclin binding consensus sequence
PPTALRE

SEQ ID NO: 781 - protein, 7 aa, Unknown Organism
  Description of Unknown Organism: Cyclin binding consensus sequence
PITAIRE

SEQ ID NO: 782 - protein, 9 aa, Unknown Organism
  Description of Unknown Organism: Consensus sequence from mitotic cyclins
  MOD_RES (2)..(3): Variable amino acid
  MOD_RES (5)..(6): Variable amino acid
  MOD_RES (8)..(8): Variable amino acid
RXXLXXIXN

What is claimed is:

1. A DNA construct comprising a polynucleotide which comprises (i) the sequence of SEQ ID NO. 136, or (ii) a sequence that encodes the protein sequence of SEQ ID NO. 396, operably linked in sense orientation to a promoter, wherein the promoter is selected from the group consisting of a constitutive promoter, an inducible promoter, a regulatable promoter, a temporally regulated promoter, and a tissue-preferred promoter.

2. A plant cell, comprising the DNA construct of claim 1.

3. The plant cell of claim 2, wherein the plant cell is in a plant.

4. The transgenic plant of claim 3, wherein the plant is of a species of *Eucalyptus* or *Pinus*.

* * * * *